United States Patent 7,811,794 (GENETIC POLYMORPHISMS ASSOCIATED WITH RHEUMATOID ARTHRITIS, METHODS OF DETECTION AND USES THEREOF) - sequence listing, part 2

SEQ ID NO: 2015 - DNA, 201 bp, Homo sapiens
actaatacatcatgctctgctgactccatatgtggctggtttcctggatccgattctgactgatggtatctgttctcacactgctaataaagacataccagagactgggtaatttataaagaaaaagaggtttaatggacttatgtgttccacgtggctggggaggcctcacaatcatggtggaaggtgaaggaggagcaa

SEQ ID NO: 2016 - DNA, 201 bp, Homo sapiens
ccatattggccaggctggtctcaaaactcctgacctgaggtgatccgctcaccttggcctcccaaagtgctgggattacaggtgtgagccacaccgcaccyggccaataatacattttagttcaagattagtgagagctaaggagaaatgagaatgctgattgttctgaaattcagtctccacatgaaaaccagctgaggg

SEQ ID NO: 2017 - DNA, 201 bp, Homo sapiens
ctataaatagggcatcgtgacccggccaggggaagaagctgccgttgttctgggtactacagcagaaggtaagccgggggccccctcagctccttctcggycttgtctctctcagatgtaactgagctgtgggctaggaggaaaaggccgggaggaggcacggtgatgactgaaaaacctctcccctctcataagaccagt

SEQ ID NO: 2018 - DNA, 201 bp, Homo sapiens
gcctgggtgcacaggtttggggccctggggaagtggttttaatgattaaaccacaaatctctgaagaggggaaacggcagaagtggaatgggggtggtccyggaaagttcacaaaaacagaactctgttcccttggatgggatcccaaagtggcaagaagacccccaagtcccttcaaaagctccccacccccaccactag

SEQ ID NO: 2019 - DNA, 201 bp, Homo sapiens
ctgtgctgttgtagcacaaaagcatcctggactattcataaactaatgagcatggctgtgttgcaataaaacttgtttacacaaacagatggtggtccagyccagatttggcccatgggctgtagtttgccaatccttggaacagataaatgttcatgctattatttgtttagtaagagtattctttagttgccaggttga

SEQ ID NO: 2020 - DNA, 201 bp, Homo sapiens
aatacagtagatgtttctaaagctaatttttaaatgaaaggacaatatataagtctatagctaactcctctgtcatgcacaatctgagttaacagaatagwttaggggttagcaagctttttctataaagggccatgtaataaatatttcaggctttgcagttcatatgttctctgttgcaacaactcaactgtgctgttg

SEQ ID NO: 2021 - DNA, 201 bp, Homo sapiens
ggtggagttggctttggaggctaaaaaacagccaaagaaacttgcacaaaatgatccacaaaaaagaaacatgacaaaaatagcaggaaagaagccaggascctgtgtgcccagccccatgtcaccctcctgaggcggtgtgcacaagctgcgtcctgtagcgtgaggaacattttctcatgaaggctcttttagaaggtg

SEQ ID NO: 2022 - DNA, 201 bp, Homo sapiens
acaggaatggaataataaaattatacattaaataagtgttgtaaatacagtagatgtttctaaagctaatttttaaatgaaaggacaatatataagtctakagctaactcctctgtcatgcacaatctgagttaacagaatagattaggggttagcaagctttttctataaagggccatgtaataaatatttcaggctttg

SEQ ID NO: 2023 - DNA, 201 bp, Homo sapiens
cgtgccaccaaacctagataattctttgtattttttgtatagatggggttttgccatgttgctgaagctggtctcaaactcctgggctcaagtgtttcacscacctcagcctcccaaagtgctggtattacaggtgtgagccactgtgcctagccagcaatattctttttaatcagttttcgattggtgaaaaagtgacta

SEQ ID NO: 2024 - DNA, 201 bp, Homo sapiens
atatagggtaggtatcaataattactcataaaagatgagaattattggttccctagaagtcattttcccattctaggcatggtgccttttaggggacatarctctgactgaactttatatgtcctccttagttagttacttagggtcttgatttcttctggaggctgtatttgtcatttaaattttgctagatattatgca

SEQ ID NO: 2025 - DNA, 201 bp, Homo sapiens
ttatatagggtaggtatcaataattactcataaaagatgagaattattggttccctagaagtcattttcccattctaggcatggtgccttttaggggacakaactctgactgaactttatatgtcctccttagttagttacttagggtcttgatttcttctggaggctgtatttgtcatttaaattttgctagatattatg

SEQ ID NO: 2026 - DNA, 201 bp, Homo sapiens
attctgctgagatgtagacatagttaagcaatcaccagccgttattctggaggtcatgaaatttgcaactttctcaattactcctataattaacatcactmctctagaccctaaaattggccttttcagattccttttcagacttttgtatttctgaaaccaggtgactttacctggacccacgacccctacctgtggtcc

SEQ ID NO: 2027 - DNA, 201 bp, Homo sapiens
ttagctaatgggctttatctagagaaaaacaagcttcttacatctttgtgacaggaggcagttttgcagcttggaggcatgtgcccactgaaggcaggctstcaccctcccacagacactgggagctggggccactgtctctcccttgatgtttgcctttcaaggagatggctcccgggtccttgagaaacacatgcctgg

SEQ ID NO: 2028 - DNA, 201 bp, Homo sapiens
tcttgtctagtgagaggtgagggggttaaaatatagggtatcctggctgggtaccctgcctcacgcctgaaatcccagcagtttgggaggccgaggtggayggatcacttgagatcaggagtttgaggctagcctggccaacatggcaaaaacccatctctactaaaaatataaaaaacaaaacaaaacaaaaaaatagcc

SEQ ID NO: 2029 - DNA, 201 bp, Homo sapiens
gcggactttattcaatggccaaagaatggagaagcaggagcatggccgcaagtcaacttcttgtctagtgagaggtgagggggttaaaatatagggtatcytggctgggtaccctgcctcacgcctgaaatcccagcagtttgggaggccgaggtggacggatcacttgagatcaggagtttgaggctagcctggccaaca

SEQ ID NO: 2030 - DNA, 201 bp, Homo sapiens
gggtgagagagcaagaccctgtctccaaaaaaaagtaaataataataaaaaaaagagtggggctattggttagtggaaggaagaccggagaggtaaagctsccctctcatctcatgatatcaagagtacctgccgtccacatgccttaccacagctgatgctggccttgatcacctggctaaggtagtgttagtcaggtgt

SEQ ID NO: 2031 - DNA, 201 bp, Homo sapiens
ggcacattccactcagaggcggcacctctgcttagtgcgctcagggggcctcatgggagagagaggattgcttcagaaggaaaaggagcaagaaacccaastggtccaggaggtggctttacggagaagtgcacggtgtggtcttgagtcccatctcctgcatcagagaatggcagagttttgtagtcggaagggaggttg

SEQ ID NO: 2032 - DNA, 201 bp, Homo sapiens
caaaactttgaaaaacaaaggagccagtagaatgatttcctattggatagcaatggaggactacggggtcgaggggaagggaggcagaggaagagggggasaggtgggcagcggcagggaggatctcctggagaaggaccacctgaatgtaaaccttttgaaaagtctacattgtatctagaatatggcatacatggggga

SEQ ID NO: 2033 - DNA, 201 bp, Homo sapiens
acctggtcaattcccgttacactgtaggcatgacccttaataagaccaaacggcgtccgggcctcagattctgcagcacttctggtctaaaacatggaaaragcagagtcacacccaccgtctaagtcaagcctcccctgctggatcagacccagctacatgcctggcccggtcacaacctccagccccttctgctgcccc

SEQ ID NO: 2034 - DNA, 201 bp, Homo sapiens
cagctagaaataagtcagggtccacacaagcttgcagtggtttgttctctaggctgatttcactggtattttttaaaagaaagtctctcgctctctcactytctctgtctttcatagatagaacaaaggtaaacccagcccagttggattaagtcctaaaatgcaggacccaatttgagtgacttgaggtgcactcaggtt

SEQ ID NO: 2035 - DNA, 201 bp, Homo sapiens
atttgagaccagcctgagcaatatagcaaaactctgtctctacaaacaaacaaataaacaaacaaacaacaaaaaataatgctttctgtacataaaccagsacataagtaatataatttcatgggatgatagtcactatagagaagataggggtggtgcagtggaataaggtgagatagggttggtgggcagggctcttct

SEQ ID NO: 2036 - DNA, 201 bp, Homo sapiens
ggtgtaggagagcccgaccaacgctgctgggtgtcactttcctctgtaaactccggggctgtgagccccacatcacaggcatgtctgactctagaggaacrgaggtgcaggggcttgaggccactggactccattcagagggagtgaggaagcagaggccgaagcagtgttgttcccccagccccgtgcctcttgggtcct

SEQ ID NO: 2037 - DNA, 201 bp, Homo sapiens
attgcttgaggcccagaatttgagaccagcctgagcaatatagcaaaactctgtctctacaaacaaacaaataaacaaacaaacaacaaaaaataatgctytctgtacataaaccagcacataagtaatataatttcatgggatgatagtcactatagagaagataggggtggtgcagtggaataaggtgagatagggttg

SEQ ID NO: 2038 - DNA, 201 bp, Homo sapiens
acaacctggaggagtgacagacaccaggggcgcctgcccagggagagctatgtgtggcattagtgtctaaaatactcaagaaagcttggccaggagaattkctgaagaacacggggtgtttttagatgcgccaaaaccccaggcccggcagaagtaaggacctcccaaatgctggcctgtcctctgccaggtctcacacgt

SEQ ID NO: 2039 - DNA, 201 bp, Homo sapiens
gcgcaggagtttgcaggtggctctgagctgagcccagaaggacaatgcaaaccaggaccatgtcagtgggcctcaatagagtcccaggaatagcctgcccsgctcagcagtagggttcagggtgggccatttaacttctcacggctgcatcctcatctgtcaccagcttagacattctgggcttgttgcagaatgtgcctg

SEQ ID NO: 2040 - DNA, 201 bp, Homo sapiens
aggaatagcctgccccgctcagcagtagggttcagggtgggccatttaacttctcacggctgcatcctcatctgtcaccagcttagacattctgggcttgytgcagaatgtgcctgcccgaagggaaacccaggagtcccccaagccctccctgtcttgattgcccagcccctgccaggggatagccctggcaagcaatgc

SEQ ID NO: 2041 - DNA, 201 bp, Homo sapiens
gtccctgagcagagggtctggattggccatacctcatttatattgagatgaatgaactccttgttctttgtactgagagcctggaacacccctgataggaragaagggggaaaggcatccttttaaagacaattcctttaccaagtttgtttcccagcgaccaaagggccttccagtggagcctgtggggaagctgctcca

SEQ ID NO: 2042 - DNA, 201 bp, Homo sapiens
aaaaaaatgtatttcagaatttacaggcccatgtgagatatgatttttttaaatgaagatttagagtaatgggtaaaaaagaggtatttgtgtgtttgttkattgttcagtcagtgaatgtacagcttctgcctcatatccaggcaccatctcttcctgctctttgttgttaaatgttccattcctgggtaatttcatgtc

SEQ ID NO: 2043 - DNA, 201 bp, Homo sapiens
aatattgagacaatgaaagatctggttagatggcacttaaaggtcagttaataaccacctttcaccctttgcaaaatgatatttcagggtatgcggaagcsagcaccccagtctgagatggctcctgccggtgtgagcctgagggccaccatcctctgcctcctggcctgggctggcctggctgcaggtgaccgggtgtac

SEQ ID NO: 2044 - DNA, 201 bp, Homo sapiens
agcctccatggggaccatgacagcctggaaagcacaggcctgtgtgccctgccctcacgctggggtctggctaatacagcagcggctgcaccatgtctggygacctggtagctgtgtctggactgaagacaaacactggctcagttttaaccaagttctagactagcttcagatttccccagaagctcaggggccatggat

SEQ ID NO: 2045 - DNA, 201 bp, Homo sapiens
accagcagggactgacttttaacagatcagttatttaagcttgtcctctgtgcctgggatggttttaggtacctgtctgcattcactgtgttaatacagtrtagtcctcaaataccgttggtccttgaacaacacagatctgaactatgtggggccacttcttggattttcttccacctctgccacccttgagacagcaag

SEQ ID NO: 2046 - DNA, 201 bp, Homo sapiens
cctctgcccactctgcactcctgcagactcagaggcagctctggggcctggcacattccactcagaggcggcacctctgcttagtgcgctcagggggcctmatgggagagagaggattgcttcagaaggaaaaggagcaagaaacccaactggtccaggaggtggctttacggagaagtgcacggtgtggtcttgagtccc

SEQ ID NO: 2047 - DNA, 201 bp, Homo sapiens
cagggggcctcatgggagagagaggattgcttcagaaggaaaaggagcaagaaacccaactggtccaggaggtggctttacggagaagtgcacggtgtggycttgagtcccatctcctgcatcagagaatggcagagttttgtagtcggaagggaggttggtgaatgaaagcaggatgcattatgtgaacacagctggcac

SEQ ID NO: 2048 - DNA, 201 bp, Homo sapiens
caactggtccaggaggtggctttacggagaagtgcacggtgtggtcttgagtcccatctcctgcatcagagaatggcagagttttgtagtcggaagggagsttggtgaatgaaagcaggatgcattatgtgaacacagctggcacagctcctgcacaggcaatcccatagtgattcagcactggggtcagcaaaccttttc

SEQ ID NO: 2049 - DNA, 201 bp, Homo sapiens
tacatggtggctggcaaaagagagaaagcatgttcaggggaactcccctttataaaaccatcagatctcatgagacttatgcactatcacaagaacagcaycagaaagatccaccctcatgattcaattacctcccactgggtccctcccatgacacatgggaattatgggagctacaattggagatttgggtggggacac

SEQ ID NO: 2050 - DNA, 201 bp, Homo sapiens
tgactctagaggaacggaggtgcaggggcttgaggccactggactccattcagagggagtgaggaagcagaggccgaagcagtgttgttcccccagccccrtgcctcttgggtcctcagggaccccatgctgcagttgcttgcctgtcccagtgactcaacctccctctcgccatgctccatccacttacactcacccagc

SEQ ID NO: 2051 - DNA, 201 bp, Homo sapiens
aatttatgtctcccatgtcagtaccttatatagggtaggtatcaataattactcataaaagatgagaattattggttccctagaagtcattttcccattcyaggcatggtgccttttaggggacataactctgactgaactttatatgtcctccttagttagttacttagggtcttgatttcttctggaggctgtatttgt

SEQ ID NO: 2052 - DNA, 201 bp, Homo sapiens
tacaaagcatgaaaatgaggccgtagatgcaaaagcttaaaagggtgacccatacctcaaaagttctcagtaagtggcagcattttattatcgtggctatyattttgccagttatatcttaacaggtataaatattgaaacctccttagcgaaaattataacggtgagcaaattatgacagcggaggagatctgacctaac

SEQ ID NO: 2053 - DNA, 201 bp, Homo sapiens
ggagggagtgcattctcaggatttacagcctcatcattcttcctgcccaatgtctgcccacagagccctgggtccatctttcctgcagagctcatggcacyggacttctccatgactttgtcttagcgtctaatcctgctcccagctcagcccagtgcagggcaggagcacgatgcacatttgctgagtaaacattgaacc

SEQ ID NO: 2054 - DNA, 201 bp, Homo sapiens
taccatgtatttaaggctggacacatcaccactcccaacctgcctcacccactgcgtcacttgtgatcactggcttctggcgactctcaccaaggtctctrtcatgccctgttataatgactacaaaagcaagtcttacctataggaaaataagaattataacccttttactggtcatgtgaaacttaccatttgcaattt

SEQ ID NO: 2055 - DNA, 201 bp, Homo sapiens
gaattttctatttttttttttttttttttatacgtggtcccagcacagactaaggaatccaactatcattgggcaagccatgctaggtatgcatgcctttrgggctctgcaggggatagcgctatgcagggatggttgagagctggttttggggttgagacacgtgggaaatacttggactttgggctgagcctgtggtgc

SEQ ID NO: 2056 - DNA, 201 bp, Homo sapiens
agccctcactgtgtggcctggagccttcctaactgtgcatcatctccccaggaccatccacctgaccatgccccaactggtgctgcaaggatcttatgacmtgcaggacctgctcgcccaggctgagctgcccgccattctgcacaccgagctgaacctgcaaaaattgagcaatgaccgcatcagggtgggggaggtatg

SEQ ID NO: 2057 - DNA, 201 bp, Homo sapiens
ttaaaaaaaattgtttttaatcatcaacattattttaatgttgggagatagtgaggaggtagttatgatgagtcctttgctactcatatgtaagatgagaytcagagctaataatcattgtaatgatgataataatagtatcagtaatagtaataatgtgacaatagctgtaatgtactggaaaccttctgtgtgctagac

SEQ ID NO: 2058 - DNA, 201 bp, Homo sapiens
aacttctgcttttttagtttggaaatgtcctttttcttacttagcagagcatgacctactaatcctgtctgtaaagtgcaaccccacgtgatctgccagtrccgtgacctcacactgcaattggccatatgcagagaaccaaaaacaatcacagcgtggcttcggtgaggaaggtgcctgggagctttcaccccaactccg

SEQ ID NO: 2059 - DNA, 201 bp, Homo sapiens
gctgttcacctcaatcacccttgagcctgtgtgccctcaggctctgcctgggagcagggacaagggccaatgcatttgagaagggttttagaggagagagrgtgaaagtaaaagacttctagttatcgactaaccagaaactgtagcagtcagaatgttttatcctcatgcatttggcataaattatattttggatgtgta

SEQ ID NO: 2060 - DNA, 201 bp, Homo sapiens
acttgtcagcatcaaaccgaaggaaaaggttctaaagggtggagagcagaagccttgagaaggagcgtgcctgaaaggcatcgctgatggcagtaaatggrtgacagccagcccgggggagctaccctctaggggccgcagaggccacagttggactgggccttccaaaagaagtcggtctcccttttgtcttccttttcg

SEQ ID NO: 2061 - DNA, 201 bp, Homo sapiens
cgctgggcaggccttggtggccctggtcccaggaggggagacttctgaagggggagacaaagatgccctccatgctggtttgtgcgtccagcttttatctyggagaattctaactttgacaaaaagtaagtgagttgtagagtacagattacactttaaactagatgatgtcaatatagactgcaaggatgggggccctcc

SEQ ID NO: 2062 - DNA, 201 bp, Homo sapiens; identical to SEQ ID NO: 196

SEQ ID NO: 2063 - DNA, 201 bp, Homo sapiens
cacccatcaccttgggcaggctcagccctggtgttggggctgctccttcaagaggggcagggcaatggatcactcacatggacgctcttctttgtggagcytcctgctgtgaatttccgagtttcctctgcccggcttctcccaccgtctgcaccagaccttctttccactagcctgacctcaggtagcctctcaaactct

SEQ ID NO: 2064 - DNA, 201 bp, Homo sapiens; identical to SEQ ID NO: 197

SEQ ID NO: 2065 - DNA, 201 bp, Homo sapiens; identical to SEQ ID NO: 198

SEQ ID NO: 2066 - DNA, 201 bp, Homo sapiens
ttacgccccagggccatgggacttgctcgtatctgcagttaacacaggaacaagcacggtaccagaattccccatcatccagagcagtgtgacacagacgyttctgctcagctggaccaacagaacgccactccggagaactaggagtaaacaaaattggtgttcaggcagaggtcatgatgaagagcaacaatggccttg

SEQ ID NO: 2067 - DNA, 201 bp, Homo sapiens
tgatggaccgtcacctcccatttgtggatcgcgtcttcctccagggcatcgggagtgaggttgcagatctccactttatcaaagtgggccttgaagtcctkaaatgccatcctgcagcaaagcggagagacacgatgcacaggagggcaagagtgagggcatcatccattcactcattcattaaatcattcacttattcat

SEQ ID NO: 2068 - DNA, 201 bp, Homo sapiens
aaatgatgcccaagccacagaggtctgcagggaacctggcaatgcttgtgatttccctatggcccgctaccccccggctccctgcgactctatgctgcaaraagagtctccatgctcatcctcagcccttttgttcctgattttacagaaatctgtaagatatgatgtaaagctcctaactcccctaaataagaaacagat

SEQ ID NO: 2069 - DNA, 201 bp, Homo sapiens
cctgggctcaagtgtttcacccacctcagcctcccaaagtgctggtattacaggtgtgagccactgtgcctagccagcaatattctttttaatcagttttygattggtgaaaaagtgactatttctacctataatattcattatggattggataaaacatattgtctaattattttggtgtcattatattcagaattccca

SEQ ID NO: 2070 - DNA, 201 bp, Homo sapiens
agcagttttaagcccacaccaaaactgagaggaagatacagcaatttctcatataccccctactaccttccagtctcccccattattgacatcccccaccsagagtggtccatttcttacaacccacgaacctacattgacacatcattattactcaacgtccatagtttacattagggttggctcttggtgttgtacatt

SEQ ID NO: 2071 - DNA, 201 bp, Homo sapiens
ggtcaaagggcatggtggtgccctgcatggcagatggtggagaaactgcaccaggcaggtgcctcaggctttctgggtcaggggagagggtcaggtggccyttgaagttctgtttgctgttagcctgactgagttaactgcatgggtacctgactgtctttgctcagtctcctagtggacaaccacatttccggaaggctt

SEQ ID NO: 2072 - DNA, 201 bp, Homo sapiens
gctggggccactgtctctcccttgatgtttgcctttcaaggagatggctcccgggtccttgagaaacacatgcctgggtaatcaagctgacaaaagtcctmtctgatcttcacaaaaatgttatatacatttgaaagagaggagaaagtgcttataattacaagttttctaaggtaaatgctctgagaataagagagggag

SEQ ID NO: 2073 - DNA, 201 bp, Homo sapiens
ttggcactgttataggacatgcttacttgggtttcagacatatggctgcctgatgcatcagctctgtgaattccagcaactccctttccagaggaccaagwctgcatacatcagtgtcagcacgggctgggcgagcagacatttcatagctgccacccaagtggttcggcagtacttgggagggtggttagaaatctccct

SEQ ID NO: 2074 - DNA, 201 bp, Homo sapiens
gccttcttggcactgttataggacatgcttacttgggtttcagacatatggctgcctgatgcatcagctctgtgaattccagcaactccctttccagaggwccaagactgcatacatcagtgtcagcacgggctgggcgagcagacatttcatagctgccacccaagtggttcggcagtacttgggagggtggttagaaat

SEQ ID NO: 2075 - DNA, 201 bp, Homo sapiens
ctaggcatggtgccttttaggggacataactctgactgaactttatatgtcctccttagttagttacttagggtcttgatttcttctggaggctgtatttstcatttaaattttgctagatattatgcatattacttaagttttcacacttaatggcataaatctgtccctagtattccctctcaattttctaatctcctc

SEQ ID NO: 2076 - DNA, 201 bp, Homo sapiens
tgtccctagtattccctctcaattttctaatctcctctgtaactgcagtctatttatatgtcctcagtaaatatttgttgagtctgatagtttttggttaygatcatggactagtgcagtgagggcagttggatattttcctcctgggaggacatctgggattcacaatctggatgtttggtatcatgagacaatctccct

SEQ ID NO: 2077 - DNA, 201 bp, Homo sapiens
gtctgaaaaatgaaggtctccacccaagaatgtcttgtgagcatgactctgggaccagtagaaaacagcaacttttcaatggtttgcttgagggagcgaggagcagagctagaagggatatgtgccttgccttgcagataagctaagaaagtgtcctgcagcctggcgtggtggctcactcctgtaatcccagcactttgg

SEQ ID NO: 2078 - DNA, 201 bp, Homo sapiens
ctcagtgcactccttgccctgggctcccttgagggcaagcctggctgtccactgccctccaatgtccccttggctttgtgctctgcccaccctccccaagyacagctgtgtttgacaagaaggtggtgctgaggaggagggccgtccagccccacggtcccacgggctgctgagacgtgcaccgtgtaatgctgagtccca

SEQ ID NO: 2079 - DNA, 201 bp, Homo sapiens; identical to SEQ ID NO: 225

SEQ ID NO: 2080 - DNA, 201 bp, Homo sapiens
ggcccttccctgaatgtctaagaccaacctggtccccacatccaaatgcacagacacagctgaggatggagaaggctaaagagggacagaggtagagacayaggctgagaggaggcagttgtaggttgagctagggctaaggtgttttccccatattccatcttaccccacactcaggccaggccttagagttgtggaagg

SEQ ID NO: 2081 - DNA, 201 bp, Homo sapiens
tttccctccttggagacagggccctgtcggtttattcactgtatgtccttggtgcctggagcctactaaatgctcaataaataatgatcacaggaatgaaygcatgctgaaaagaccactcttttgcacaccatctgctcaaagctcctcttgtctgtcctgtccgctttcagcctccgtctgtccacttattaagtttgc

SEQ ID NO: 2082 - DNA, 201 bp, Homo sapiens
aaaggctttcagacttctctggagagtcctggagctttgaggggctctttaggggccatctgggttcggagattagcacactctgccccacagtggctcarcttttatctgcttcacatactgggcttctgggaagatcttatttcagtaaactatttcacaataggaaatatatttgaaaactcttgaatgattctgtgg

SEQ ID NO: 2083 - DNA, 201 bp, Homo sapiens; identical to SEQ ID NO: 227

SEQ ID NO: 2084 - DNA, 201 bp, Homo sapiens; identical to SEQ ID NO: 230

SEQ ID NO: 2085 - DNA, 201 bp, Homo sapiens; identical to SEQ ID NO: 232

SEQ ID NO: 2086 - DNA, 201 bp, Homo sapiens; identical to SEQ ID NO: 233

SEQ ID NO: 2087 - DNA, 201 bp, Homo sapiens
cttgctttgaagtcagacagaccaggatggaaatactggctcttctttactagtttgtgatcttgggtggtgataggaaagcatttttctattctatgcaraacacccagtgccacgaagaaagccgtgacaggtgcagcctgaatgccagtcaactggcaaattgtggcatctcttaacatttatcaaaatatccttatc

SEQ ID NO: 2088 - DNA, 201 bp, Homo sapiens; identical to SEQ ID NO: 237

SEQ ID NO: 2089 - DNA, 201 bp, Homo sapiens
tctgtggggtagggctgcttggcttgactttattttggaaaatgtattcatttctgtgggagctgaggatttctgctgcccgcttcctctcttgtgaccascactcatacatggagttagcaggtgaagaggacagcctcctcatcccctctttttataccttgcccttttgtgggaagaggctgaccattccccaatttg

SEQ ID NO: 2090 - DNA, 201 bp, Homo sapiens
tgatgtcctgtcctgaaagaaagaaaaataaaggaaagtgggcatctgagcactcatttgaaggaaatcctccggaatcgattcagaaatcctcatgaagkacccagaattccctgctttggagccagccagaccaggatgaactaaaagtgactgaacacttattatctgccaaccactttacatatattaactaattga

SEQ ID NO: 2091 - DNA, 201 bp, Homo sapiens
tcaggccaggccttagagttgtggaaggtggagaacactgggaagccaacctccgaagaagaccaggttggagtcaaaggaggaaggagagctctcattgycaaaccaacagggaagccaaggatatcccagtaactgctctcacatcattgatgagaatgccttgaatccgagctactaaatcacatttccttccttcta

SEQ ID NO: 2092 - DNA, 201 bp, Homo sapiens
tgaggatttctgctgcccgcttcctctcttgtgaccaccactcatacatggagttagcaggtgaagaggacagcctcctcatcccctctttttataccttscccttttgtgggaagaggctgaccattccccaatttgatgtttattgcttcaccttaagactttgtcttcagtgaaaatgcaaatactggtagggaggga

SEQ ID NO: 2093 - DNA, 201 bp, Homo sapiens; identical to SEQ ID NO: 228

SEQ ID NO: 2094 - DNA, 201 bp, Homo sapiens; identical to SEQ ID NO: 229

SEQ ID NO: 2095 - DNA, 201 bp, Homo sapiens; identical to SEQ ID NO: 231

SEQ ID NO: 2096 - DNA, 201 bp, Homo sapiens
gattagcacactctgccccacagtggctcagcttttatctgcttcacatactgggcttctgggaagatcttatttcagtaaactatttcacaataggaaawatatttgaaaactcttgaatgattctgtggattttttcaggggtggagggtttcagggaccaagatggagactttatcttctcaaatacttaaaactcct

SEQ ID NO: 2097 - DNA, 201 bp, Homo sapiens
ttcttacagccacattgtgctgttcacatggtctgtgcagaagtcatcatgtttaaaacagagtggtaagaagatgtcacccaaagagatactacattttsccagttgactggcattcgggctgcacctgtcacagctttctttgtggcattaggagctctacatggaatggaaaaatgcttctcagcaggaacattctag

SEQ ID NO: 2098 - DNA, 201 bp, Homo sapiens; identical to SEQ ID NO: 234

SEQ ID NO: 2099 - DNA, 201 bp, Homo sapiens; identical to SEQ ID NO: 236

SEQ ID NO: 2100 - DNA, 201 bp, Homo sapiens; identical to SEQ ID NO: 235

SEQ ID NO: 2101 - DNA, 201 bp, Homo sapiens; identical to SEQ ID NO: 238

SEQ ID NO: 2102 - DNA, 201 bp, Homo sapiens
aagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaatgcatgctgaaaagaccactcttttgcacaccat

SEQ ID NO: 2103 - DNA, 201 bp, Homo sapiens
ttgccagaatctcagaaagaatctctggactctggctcaggacctctgaggtgattatgcatctagaggcatccccaggtgctgcccaatttggggaagcrgcacttcccgctggaagctgggaagtttcccctggctgggggtcctgtgaggatggagaggccagaatgaggaatgggttgtgagtcaagaccaaccaga

SEQ ID NO: 2104 - DNA, 201 bp, Homo sapiens
attttcccatcaaatgttcttccaggaaaagagaaccttttctaatgattttaacaacagccaaaataatttttcgatggtacagaccttcccctggctgkcttttctggtatacagatactgctgctggtgcatacttttccaaacgcgatgcgctagccttcccaatcaaataagcctttttatttccaatgaagtaaa

SEQ ID NO: 2105 - DNA, 201 bp, Homo sapiens
ttggccttggatctgtcttcattaatatttctttctttctttttttttttaatcaaagtttttagcagttcagtgaatatgtcaaaacttgtgggactgtrtggggtgccccaaggaaacacaggctttagagatgaatgtggccagcgcagtaatcaatttatttaattgcttgagatgttatgctagaatgaaaacagc

SEQ ID NO: 2106 - DNA, 201 bp, Homo sapiens
gcaaacaaagttgaatcatgaagtgatgtcactctgaaccaattggagcagtggtgtcatgtgcctggcagctacttcaaatgcccacaaaacaggagtamtggtttaagctgtttccctcttcccctcccaccaccaatcagcagcagactgctagaggacagatgcaaaacagttattagaccaggcttagttagacat

SEQ ID NO: 2107 - DNA, 201 bp, Homo sapiens
gtgggcacagggtttctttttggggtgatgaaaattgttctaaaattagtttgtggcgatggctgcatagctctaaatatacttaaaaccattggattatrtactttaaatcggggactttaatggtatgtgaattatatctcaataaaccctttttttttttttttaaagaaatgtgatcaggttgaaaataacttgtta

SEQ ID NO: 2108 - DNA, 201 bp, Homo sapiens
tgtcttggggtgctgagcctgttcccccctcatttgggggtgtggtgctatgctggcgtttgggtccatgccccgcatttctgatggctgccccatctgcyctgtgtggggtggcagagttctgtgtacacagagttacatttcgttgttcctggcttctctatggatgacagcagcactgataaatgccacacctgcttt

SEQ ID NO: 2109 - DNA, 201 bp, Homo sapiens
gctgttcctctctctttctgtttgaaagtgacttggcagggtgaagttgagaaccccttggaaaggaggaagccgaaatgcaaacaaagttgaatcatgargtgatgtcactctgaaccaattggagcagtggtgtcatgtgcctggcagctacttcaaatgcccacaaaacaggagtaatggtttaagctgtttccctct

SEQ ID NO: 2110 - DNA, 201 bp, Homo sapiens
tagaaacacgcctcctttgggcatatggtgtgaatcagggactctggctataaaaggtggggtctctgagcaccatcctggttggaatgttcccctgactyggaggtagcgagagacagccaaggtgtttgttccagggaggctggtgggtgggagatgggatttttctgtctgtggcacaggcagtattaagtagagcag

SEQ ID NO: 2111 - DNA, 201 bp, Homo sapiens
aatcttgattagacctgccagagctgtgcttattttgtgtccccatccaaatccagaattaattgccgtgctccacatgttttggtcaatggtggacctcrtctgtaacagtagtcccatgagattataatggggctgaaaacagtgctgtcccctagggatatcgtgtctgttgtagtgcaaggcactgctcacgtgttt

SEQ ID NO: 2112 - DNA, 201 bp, Homo sapiens
gacgcccgctccgccggctgtggtgtgcgcccttcctgctctcccctccgaggggctgaggctccttttgtctggcgcgcgcgccccaccccgccccgggygagggaagagggagcgggcaccccgcgcccgcgccgccgccgtggaccaaggttgtttactactttccactccgaataacacgccaatcaccagggccca

SEQ ID NO: 2113 - DNA, 201 bp, Homo sapiens
ctcaaatgatccacgtgcctcagcctcccaaagtgctgggattacaggcttgagccaccatgccctgtccgattatttttcagggaagagccagtgtgctycagccctatgagctctacccttctgctcccacagaagggaagcacaggcctgtggggtggagggggctctgccctaagcgcagcccctgtgggccacggg

SEQ ID NO: 2114 - DNA, 201 bp, Homo sapiens
ttggatcccctctgctaagcccctctgtgcctttgttcctgcattccctccacccccagtcccctccccacatcagtgtccacctgccaagccaggccagygccactccctccccgaagctttcctgccccactccagtagctatctcctctgctaacttctcgatgcgcttgactcacatcctcgtatgtgttctctctc

SEQ ID NO: 2115 - DNA, 201 bp, Homo sapiens
agcaggccgagaaggaggaggctgaataccgcaaagtctttgagaatttcctgcacaactccatcttcgtgcccaggtacccagctcatgtgaaatttcakttggcaaaacccactgctcaggccggttctgttgcctttctccccaccaggtagtgtgtaagtcagcagctggggggtacaatacagtagccactgagac

SEQ ID NO: 2116 - DNA, 201 bp, Homo sapiens
tctttgtctttactgacactcaggatcattgttaggtgggaggtcagatcaggcagctggagtccccagtgtggtgagtttagttggcaggccccagattyctcctgcattcatgggaaattgacatgtatgttttatttccccaggatcagcgagaatgtgtgtccagacaggaatacaggaagtatggaggggccaagc

SEQ ID NO: 2117 - DNA, 201 bp, Homo sapiens
atccatctgatcatcgctctgcccgtcgctgtcctgttgatcgtgggagggttggtgattatgctgtacgtcttccatagaaagaggtcagtgatgtgcaragttatgacactttctgtggctgagtggtttgatgatttgaatgtgagtgaaggtgatatttttgaagatttcaaggaaatattttatggactggaaaac

SEQ ID NO: 2118 - DNA, 201 bp, Homo sapiens
ttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagca

SEQ ID NO: 2119 - DNA, 201 bp, Homo sapiens
taatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgct

SEQ ID NO: 2120 - DNA, 201 bp, Homo sapiens
ttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgact

SEQ ID NO: 2121 - DNA, 201 bp, Homo sapiens
tgcttatttagtctttggctttcccttgttgttagacactgcctgtcactcgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagt

SEQ ID NO: 2122 - DNA, 201 bp, Homo sapiens
aaaagaagggccagagcggtgtcctgcagagggtggtgtaccttgggagggaagtgtgtagggttgttgaggaacagtgtgctgcacagggaggaaagacrtggggcagcattgtgggaagagcaaccaagattctcataggcttgggagcggaagccctgaggtctgttgctggactagatatgtgaggtgtgagaggag

SEQ ID NO: 2123 - DNA, 201 bp, Homo sapiens
ccagagtaaacattgcccctcaagatcaactcctggagtagcctctggtcttgcttatttagtctttggctttcccttgttgttagacactgcctgtcacycgggcattcatccatctttgaaggtgggtgccttcaaagacagaacaagagctgccctgtcctttagtaggcctcaggtggtagaaagagcacggaggtg

SEQ ID NO: 2124 - DNA, 201 bp, Homo sapiens
atcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcactcgggcattcatccatctttgaaggtgggtgccttcaaa

SEQ ID NO: 2125 - DNA, 201 bp, Homo sapiens
aacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaat

SEQ ID NO: 2126 - DNA, 201 bp, Homo sapiens
tggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttg

SEQ ID NO: 2127 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaaggtaagggtgcagcagcggcctggacggagggtgtgaccgttcattcctgtggt

SEQ ID NO: 2128 - DNA, 201 bp, Homo sapiens
caagtgagatcttcttgtcagtgcttaatccagcctcccgttgtttgtcagccctagctggaggcctcacaggagttcctgtgtccttccagtttgatacsaagtttagaccaagaaaagttcctttctgtggcacacctgtagtctcttacctgtctttggtggttgtacacgaacaggcagatatccacaactgcagaa

SEQ ID NO: 2129 - DNA, 201 bp, Homo sapiens
gactttgtttgaagagtcacccaggtttttgtaaagaagtgtttcagatcagtatgcaatggatgactgtaaatttctcttcagatctaagaatctgtgaytggatgaaagggagaaaggactgcataagtgcttgttgcttgtaaactgggccaggtggatgtcatggccctaggagcttcttgcctgcctttgcatgcc

SEQ ID NO: 2130 - DNA, 201 bp, Homo sapiens
gcctggcacagggcagggcctctccagatggcagttcctgtctgtgtcttattcccaccctccgggcacatggggggaactcagtttctccccactgcgcrtcaccctgggagaggtgttttttgtgccaattgccattttaaatccaaatcagcagggatcatgtttgctgttcaaccatgtggcatatttatagtgatt

SEQ ID NO: 2131 - DNA, 201 bp, Homo sapiens; identical to SEQ ID NO: 252

SEQ ID NO: 2132 - DNA, 201 bp, Homo sapiens
gtgtagacaagagctgctgtagacagtaagctctccccattctgttctgataccgtgtgagagaggataaatgaaactgttgtagcgaagatgaaagtatwtacaggaatgtatggaggtggggttttgttaacgtgaatttaatctttttgacagaaataacagcaggctggggaatggagtgctgtatgcctctgtgaa

SEQ ID NO: 2133 - DNA, 201 bp, Homo sapiens
gaggccgcaagcatgcgtgagaggattgagtttctcaacgaagcttctgtgatgaaggagttcaattgtcaccatgtggtaagagaaagttcctgaaaagycaaaatgcagcacagggagagggtatcacacaagcctcccagtatgttcttggctgcatgtacccgtgggtttggtgtcttgcctttgccttctggatag

SEQ ID NO: 2134 - DNA, 201 bp, Homo sapiens
cactttccaccagctcagtctctagggctttatctttctctgttcattgttacccgttgccagctttagctcagtgttgtgtgagccacacttcttcatcrttgaggtgttcctgttgtcagtgggctagctaagggcagaagggcattcgtgggattttaaagaatttatgggaccaacattctttccgccttcagcaga

SEQ ID NO: 2135 - DNA, 201 bp, Homo sapiens
atcaatttgtacaaaaatctttgattcaccgaaagtagctgaagcagcgaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgc

SEQ ID NO: 2136 - DNA, 201 bp, Homo sapiens
ggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcaaggtcccaagagctcttggttggaaatctcctgccccaggtttttcc

SEQ ID NO: 2137 - DNA, 201 bp, Homo sapiens
agtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaa

SEQ ID NO: 2138 - DNA, 201 bp, Homo sapiens
gcatgggtgacagcaggcagactgctcgggtggaatgggcatcagctgcagggaagccgggggaagaacagggcacaaatcagagttcagtgtgagacgcrgtgagtttgtgggtagcccagtaactgggaacttggaatggagcagttgggccgggagggccagggtgggagccgtgccgtgagaactggctgcctgcaa

SEQ ID NO: 2139 - DNA, 201 bp, Homo sapiens
ctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaaga

SEQ ID NO: 2140 - DNA, 201 bp, Homo sapiens
gcttctgctaagaggtttccttccagggactccatgttcactgcctcacaaaggcaggccagcctcatgctttagacatccttgctcttaacaaatctttygtgttctgctacgtcagcctctgtgtgacacccattggaccttctctctgtagcacaattgcataccttgctctgttcttgataagataggtctaggagt

SEQ ID NO: 2141 - DNA, 201 bp, Homo sapiens
ctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggtt

SEQ ID NO: 2142 - DNA, 201 bp, Homo sapiens
gtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcattt

SEQ ID NO: 2143 - DNA, 201 bp, Homo sapiens
actgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttggg

SEQ ID NO: 2144 - DNA, 201 bp, Homo sapiens; identical to SEQ ID NO: 241

SEQ ID NO: 2145 - DNA, 201 bp, Homo sapiens
accccattagctaacttccagcaaggctgtgttaggaatgtggaatcaattagatgaattttgaaaataacttggtctgttctaaaaggccctatgagatycaaactgttgtggcctggtgcctggtaactttgatggccattttgaaatgttaccgtagtgataattcttctggaatctcaagtcattaaaagtgatatg

SEQ ID NO: 2146 - DNA, 201 bp, Homo sapiens
cccacggttttgctggttgacagtgatttgtcttgttccttgcttgtaattttattaggaccatggagccaaagtggctggtttgaatctcagctcttcastagctaagctctcaggcaaataatttaatcttcttgtgcctcagtttcctcatctgtgaaattataattttaatagaatctactttaaacattcatagaa

SEQ ID NO: 2147 - DNA, 201 bp, Homo sapiens
tccttatagttcaaaggtctttttctcaacttagttgatgatcatgctgtaagttgttttcttttgctttatcaacttttaaaaacgtttattaacttttwaatttgaaataatttcagacttgcataaaggttacaaagagtaccaggagttctggaacaccctccacccagcttccacagatgttaacatcttacataa

SEQ ID NO: 2148 - DNA, 201 bp, Homo sapiens
taataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttg

SEQ ID NO: 2149 - DNA, 201 bp, Homo sapiens
ccaaatcagcagggatcatgtttgctgttcaaccatgtggcatatttatagtgattttttttgtaatcatggtttttctttctggaatttcaagtttttcrtttgtgctgaggaaggtcgtttgtgttttttaataggattccttcttttccaccttgtgcaagtaaaggcaaatcccctatttgcatgtcactgtattaa

SEQ ID NO: 2150 - DNA, 201 bp, Homo sapiens
acgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatc

SEQ ID NO: 2151 - DNA, 201 bp, Homo sapiens
aatcattttgactttcacagagtgatagtgtctagagagggtttttgttgtactaagttattggttccaaagaattcattttaagaggagtaaagaactaytatagtatgccgcttactgagacaaaaccgacttctcacataagcccaaaggttttgttatgttggattttaccattagagttaaagatgatgattggtt

SEQ ID NO: 2152 - DNA, 201 bp, Homo sapiens
atgtatctagacattgacagatgttaacctgggattagggggtggggagaccaaaattgtaccctgttgagaaccactggaccagagtcatagcaatttgyagtggatagatttaggaatatttgaagacttgtaaaatatagcctgaagggaatggagactgggagagtgaaagatacctctgagacattttggcttgga

SEQ ID NO: 2153 - DNA, 201 bp, Homo sapiens
tttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaccagcttgccctctggcaagctcctttaagagttagctgtaatttcaccc

SEQ ID NO: 2154 - DNA, 201 bp, Homo sapiens
ctgtgctgtggctgggagacctgtttggtcttggaagctgggtcctggatgagcagaatgaggcaggcatagaggtgatgttggctacgggcaggggagcrtttgctttgccttggagtagtgccatttccatgtagaggggcaagatttaccaccctgttgtggggatttgagactttgggttttgttttcctttacacc

SEQ ID NO: 2155 - DNA, 201 bp, Homo sapiens
ccttcctcccagacattttgaacagttcaggctgtactcattcgtgtctctttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcc

SEQ ID NO: 2156 - DNA, 201 bp, Homo sapiens
cgctggatgtctcctgagtccctcaaggatggagtcttcaccacttactcggacgtctggtatgagaacctttactgcattgccagcctggagcccccagyctctgcactttccaccagctcagtctctagggctttatctttctctgttcattgttacccgttgccagctttagctcagtgttgtgtgagccacacttct

SEQ ID NO: 2157 - DNA, 201 bp, Homo sapiens
cgggaaaccactgcaggcggcccatgaagcctcctggccatgtgcgccctcccggtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctcctt

SEQ ID NO: 2158 - DNA, 201 bp, Homo sapiens; identical to SEQ ID NO: 254

SEQ ID NO: 2159 - DNA, 201 bp, Homo sapiens; identical to SEQ ID NO: 256

SEQ ID NO: 2160 - DNA, 201 bp, Homo sapiens
tgttcccctctccagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaaggtaagggtgcagcagcgg

SEQ ID NO: 2161 - DNA, 201 bp, Homo sapiens
ttatatctcaataaaccctttttttttttttttaaagaaatgtgatcaggttgaaaataacttgttatgctaccttaaattacgttaaaattattacatayatttgacaggctgatgtctctctctcttttcatttatgagtttttcagatccgtgagttgcagcaatacaacaaactgataattgaagcttagcaacagg

SEQ ID NO: 2162 - DNA, 201 bp, Homo sapiens
ggttttgtaggatttggagacagagacaaatttggagtgtttggatgttcggggacctgcaggaggtatgtgaggtgtgtaaaatgcagcccctgttttawaaagagcttacattgtctcttgagaagataaggtgtgcccagctgtggaatggaaccagatgcttttatgagtgaggatggagtgagcacactgggaaag

SEQ ID NO: 2163 - DNA, 201 bp, Homo sapiens
gccaggcgcagtggctcgtgtctccaatgtcagcactttgggaggccagggcgggcagatcgcttgaggtcgggagttcgagactagcctggccaacgtgrcgaaaccccgtctctgctaaaaatacaaaaattagatggttgtggtggtgcatgcctgtaatcccagctactcagagaagtgtttgaacccgggagttgg

SEQ ID NO: 2164 - DNA, 201 bp, Homo sapiens
cttatggtttccactggctcggctccgtgcgtgtgcggattgggcttcctgagagcctggttagccccttttatctgctctctgaaacctgcgcaagggtktttagcatgcaccttgaaacctctgctgcctgaagacagtgtgcttaaatgaagggtatacaaacccatgtgaggttttctcttcccttttccatgaact

SEQ ID NO: 2165 - DNA, 201 bp, Homo sapiens
cacacctgtagtcccagatacttgggaggctgagatggaggtcaaggcttcagtgagccatgatggcaccactgcactccagcctggacaacagagtaagmccttgtctccaaaaaaaaaaaaaaaaaaaaaaaagccaaatctgttgggtttttttttttgggggggggggtcctttagaatggccctgacagatcttta

SEQ ID NO: 2166 - DNA, 201 bp, Homo sapiens
ttggacttacttgctttccatttatatgttgtctaattccaaagagatttcgagacagctttcaattaaaaaaaacaaacaacaacaacaacaaaaaaaamcaccacataccgcatgggtattacacaggacctgtatggtcaaattggcaacgaccacaccacatgagaaggaagattattcttcctggaacctggctcc

SEQ ID NO: 2167 - DNA, 201 bp, Homo sapiens
aaagaaaagaaaattggagaatttataacgtctgatgtgacctgttctttaggtgttgaaattagaacggcctcactcacctgggacattcttcagctcaygccctgtacctggcttacagttgctcagtgaaatgctttcttgattgtagcatggtgggatttttataaatccaaatgacttagaggtaggtgtcacatt

SEQ ID NO: 2168 - DNA, 201 bp, Homo sapiens
gccaaaaggctgggcccttgtctcccaccccactgctgttactcatgtgttctcccacttgctcggcattctttcccatgctttttccttgatcatcactyactagctaacatctattttttcctaaacactctgttgcagttgtagtctgcagtcactctcctaagacttgatcatctattacgctgtttcgttctttat

SEQ ID NO: 2169 - DNA, 201 bp, Homo sapiens
ctgtgcacagggagcaaaccccaagccgactgcttgtctgtgccaccctcaaacaatgatttccccaaattggacagcctgggtttgtatccttgagcacrgttttgggaagagcattctgcatgaggcattgtagctatgtatatggagtataattctgttttcaggttgctctgccacagaggttaagaactccctctt

SEQ ID NO: 2170 - DNA, 201 bp, Homo sapiens
tggtttggtccagccttagagcgggtttgcaggtagacaccttcctaatgtttgttccacgtaagcccccggagcacagtatttccatcagctattttgtrgaagtgagcgattctcttttggttgtaaaccttcactatttcatgtgggtgacttgacaatggctccatttttgaatggcccattgatagttgtagtcta

SEQ ID NO: 2171 - DNA, 201 bp, Homo sapiens
cacatgggagcatctttttattttattttacttttttttaaaaaaatgaggtctttattatcctggctggagtgcagtggtgtgatcatggctcactgtarccttgaactcctgggctcaagtgatcctcttgcctcaacctcccaagtagttgggctgatagacatgagctactgtgccacgtagcattcttggggatta

SEQ ID NO: 2172 - DNA, 201 bp, Homo sapiens
ttgaacacttgattgaggtggtgcctgccaggtttctccagtgtaaattttctgcttttcgcattgttactgatatcttagggctgatactcacagtatgyagatgtctcgtttctcttttttcatatttcttttcttttttctttttttgagacagtcttgctctgttgcccaggcaggggagtgcagcctcagacttct

SEQ ID NO: 2173 - DNA, 201 bp, Homo sapiens; identical to SEQ ID NO: 255

SEQ ID NO: 2174 - DNA, 201 bp, Homo sapiens
gctctgcagtgaacaattgaacctcatttctttaataataatacaggattcctgaaaaccaactgtattattgtttggaaaatagtttaaaaattatttcyttctaactgagacgtttaccctcttgtctcccttcagtctgcgggccaggcatcgacatccgcaacgactatcagcagctgaagcgcctggagaactgca

SEQ ID NO: 2175 - DNA, 201 bp, Homo sapiens; identical to SEQ ID NO: 259

SEQ ID NO: 2176 - DNA, 201 bp, Homo sapiens
tggccattgaaagaaaaaataaatagcaaaatccccatcccagaagttctacttcctgttgttgtactattgagctctgaaaaacagctttgtaagtttargctcttgtttggactatttcagtggaattcttgagatctttttgtttggacaggcaagtatgaaggcgataagtcgaaagaactacagcttactcagcac

SEQ ID NO: 2177 - DNA, 201 bp, Homo sapiens
aattctaaagcttaagtaaattcagtaataataaactgtcaattatccaagcgatgaatataaatccataaggtttttcaaatccccagaaatccctttcrtctcccacctggttttgctgagcgcctgtctcttctgtctcttttctgattcccacctttcacttttcctccatttttcgcttaatggatttatacttta

SEQ ID NO: 2178 - DNA, 201 bp, Homo sapiens
ataagaagctgctcaagacatttacctatcctgaatgtttcaggccctcaaggtgccaggtagctgcaatatagttctagtgtagaaaagaaaaccctgaygaggtctatatattccaggactctgtctgaggccctttgacactccgggggcaccctgccgtgaccctgactctttcctgcatgtactgaggatggaggt

SEQ ID NO: 2179 - DNA, 201 bp, Homo sapiens
atcaggcctttctctgaaattcccatcaataactacaagatctgcccagtaccttgtgcatatcaggtctcaggaaattgtgagtttcttgtttcattaarcatttttctttccaggaatcatcattcatcgcattgccatatgtgtccagatcccccttttcagggagccagtaattcgaaagcacttgcctgtgttgaa

SEQ ID NO: 2180 - DNA, 201 bp, Homo sapiens
ggtgtggctttcatagctttggttctctggtcttcactttatctgccaagtgaagacatttgactggatgtcgtgatcttgagttgctttcagctccagawttcgaagaccccttccattgggcattcatctaatttcaaagatgctccctggctccagctctgcagtgaagcagaacaaactgatacagcctagcttggg

SEQ ID NO: 2181 - DNA, 201 bp, Homo sapiens
ttgaattgcactgaaaacgaaatttcataggtacacgatacagtagttagttttaaaagtttttaaaatattaaaaaattgaaagtatttaaaatattttwaaaatattttaaaatctgctgtgtgagatagataggagacctagcttttcttccttcttaccttgatccatagagaaagcaaccctgaaagaagaaaaac

SEQ ID NO: 2182 - DNA, 201 bp, Homo sapiens
gcagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtacc

SEQ ID NO: 2183 - DNA, 201 bp, Homo sapiens
tacgtggtgccaggcaggtatccgggtacctttttacgtagggtattcagagaaggtctctagagaggtgacatttggacgaagacctaaaggaaagggargggaaaggcgaggagcttggagagcttggtgcatcttggtgggggatggggtaaactgagtcagttatgtagggccctggaggccacggtgaggacttcg

SEQ ID NO: 2184 - DNA, 201 bp, Homo sapiens
agaccccatagtcctgtggtttaccttctaatgagcatacttttgtcgatcaaacagggtgacctctctggtgtctctgcacactacctgtatggtctttscgtagctgatggggtctcctgactagtgattggtgattttaatctggattttgccacagcacttattttctaacatatgacttaatttacttaataattg

SEQ ID NO: 2185 - DNA, 201 bp, Homo sapiens
gcaagaactcagtgggtgagcacttccatttcttcaacaaatgcttctgagtccctgacctgtgccaggtgctcttcttgagctgagaatcctgcagggaraaaagagataaagaccccatagtcctgtggtttaccttctaatgagcatacttttgtcgatcaaacagggtgacctctctggtgtctctgcacactacct

SEQ ID NO: 2186 - DNA, 201 bp, Homo sapiens
cttgctttccatttatatgttgtctaattccaaagagatttcgagacagctttcaattaaaaaaaacaaacaacaacaacaacaaaaaaaaacaccacatrccgcatgggtattacacaggacctgtatggtcaaattggcaacgaccacaccacatgagaaggaagattattcttcctggaacctggctcccttgagatt

SEQ ID NO: 2187 - DNA, 201 bp, Homo sapiens
gtgccttttgatttgatacctatttatttgtttggaaagaagcttttaaaatcaaaaccatgaatctgtggttatcttcaaaggataaattatgataggtrgttgttacccaggttaccattttaagatgattatggctggcccaaattaggggatcttttcatatatgtattatatattttaacttcagtcttttaaaaa

SEQ ID NO: 2188 - DNA, 201 bp, Homo sapiens
ttcaagatttctctttaggtaaatagatttgtatttttgatggccatcctagtccagtgtaaagatatggacaagaaaccccacataaaggaagcaagatygctggctgctttctctaggtagcttgagttgtatactaatttgtagattatttctcttcatcgaaaaaacaaaacattctgcagagggcagtcatgtgtc

SEQ ID NO: 2189 - DNA, 201 bp, Homo sapiens
taaagtgtgccttttgatttgatacctatttatttgtttggaaagaagcttttaaaatcaaaaccatgaatctgtggttatcttcaaaggataaattatgrtaggtagttgttacccaggttaccattttaagatgattatggctggcccaaattaggggatcttttcatatatgtattatatattttaacttcagtcttt

SEQ ID NO: 2190 - DNA, 201 bp, Homo sapiens
gcagtactgccagactcagggacccagttcatcgagaggggcagtgtttctcttatgctgccttaaaggcattggatgccttttggaaagccagtggacarctcctgcatccacccaagattaatgttaacagcttaaagaatcattgcaatcaagggaaattttgcaacactttgttgggatatttttaaataaatgtgt

SEQ ID NO: 2191 - DNA, 201 bp, Homo sapiens
ccaaatacataaccattattatatgacttagcatttataaggcatttctatgcatcctgagagactagagcactctcaaatgaggtttcagagtaagattmatctttgcaaatgaagacaaattagcaaaatcttcctatttttaaagtgtgccttttgatttgatacctatttatttgtttggaaagaagcttttaaaat

SEQ ID NO: 2192 - DNA, 201 bp, Homo sapiens
ttcttaccttgatccatagagaaagcaaccctgaaagaagaaaaactcacccatttgagctttcttttgtttccactgagcaatacggaagaaattcaccrctggttataggtcttcagtgctttcttcagagtgggattgttttttgtttcaccataagtagtagtctattaaattaacagttgctagagaagaagctgc

SEQ ID NO: 2193 - DNA, 201 bp, Homo sapiens
ttctggcattgggaaagaaagaaaaatggcactagcagccttttttttttttttttttttttttccccaaaaaatttgctactcttgaggttctgtcaaaraatgtgctgtggcctctagaagcatttttaaaaagagactttcacaagtgattgtgcaaaattgtgaggtcactgaataggtgtgtatcctcctaaggag

SEQ ID NO: 2194 - DNA, 201 bp, Homo sapiens; identical to SEQ ID NO: 257

SEQ ID NO: 2195 - DNA, 201 bp, Homo sapiens
ctgggacagatctgcttcttgatactgcagggctccagccttccttccagccagctcatttctcagggaagccttgttttcctttttcagaaaatttaaaygtatatttaacgcacaatttaactccctttcctgttgataatttttttcttcttcatattttgttattaataatagcttacagaatgggatcagtatcag

SEQ ID NO: 2196 - DNA, 201 bp, Homo sapiens
ctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagaggtcagtcgcggccacacgtgtggtcactaccc

SEQ ID NO: 2197 - DNA, 201 bp, Homo sapiens; identical to SEQ ID NO: 245

SEQ ID NO: 2198 - DNA, 201 bp, Homo sapiens
ctgggggtgtgtgggggtggttggttggggtttgcttgttagtttgttgtaaaagcccagcttttcattcttggaaagatttcagccaactcgagagggtkacctgccaggaatgctgcagaagcaagaactcagtgggtgagcacttccatttcttcaacaaatgcttctgagtccctgacctgtgccaggtgctcttct

SEQ ID NO: 2199 - DNA, 201 bp, Homo sapiens
tacaggcatgagccaccacacctggcctgggttgctttttaaattcatacctactgtcttatttgggtctcaaatgtgatcagtggttatacttttcttgstatgcatttaagttggagcaggctccggggcaccacttccctccctagagttgatgaacccctcatatcagtgacctccccatgtcacagtgtatctcgt

SEQ ID NO: 2200 - DNA, 201 bp, Homo sapiens
tagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgatta

SEQ ID NO: 2201 - DNA, 201 bp, Homo sapiens
atgcattgtttgtatgaataatagcttctaaaaagaaaatcagtaaggaagggagtcatcccagatgatggaattgatagaacaaggcaagaccactttcyccctctgtgagggtggactgtgactctacgagagaagctattctgctttgaaatgcggcactagaggttggtgtgtgtagcttttgactgtgaagtgtcc

SEQ ID NO: 2202 - DNA, 201 bp, Homo sapiens
aggcagcctgttgacccaacccatgcatgccggtctttgggactcctagatgtggaccctggagtgaatagggatcaggtgggaaatgagttcctttgatsaagatccttgtaccagtgaactgaccccactccccgtctggattcctgtggtgattaccctctgtattagtctgttttcatgctgctgataaagacgtac

SEQ ID NO: 2203 - DNA, 201 bp, Homo sapiens
gagatactgtatgcaaagaattgtcatgaagacataaaatcaagtcttggtgtaaaacttttaataaatttaaaggcatgtctctgtttttctcctcctcyatggggattttcatgtggttagtaataaaactgtaggcagttgtatgtctagatttctatgtaatttgtttgtgttcgtatatgcacacctgtatacatg

SEQ ID NO: 2204 - DNA, 201 bp, Homo sapiens
acagcaactgtctgttctcctatagtgttaataactaaatctcttattggcaaaggaaatgtattgtggagcaggtggcaaagaggacctgtgttacgtgrccagcaggctagaggggactgtggccaagggcaggtgcgctaacatcgatttctgtgcttctaggaattactccttctacgtcctcgacaaccagaactt

SEQ ID NO: 2205 - DNA, 201 bp, Homo sapiens
gccccttgttttcaggttaggaaacccaggttcatgtccaagtccctgggcaagtagccagcgtaactgattgacctaaaacaaaggatggagcccttggrgctctgcatagtgaaatgtatgatttcttagtggaaaacgagaaagccactgaggaagcccagaagggaacttagcatatacagccagctttggggaagg

SEQ ID NO: 2206 - DNA, 201 bp, Homo sapiens
tgctcttctgagttctcttctcaaatacctgttttcttgggtcacaggagattaggagattaaagccattctctctggtcctgcacctcccttgccaggcrtggctaagaggtttgtccttgtggaaggagctgagtgggttggtcgacctgtgcttttccgtgggtaccttaattctaccccatattccgtaatgctttc

SEQ ID NO: 2207 - DNA, 201 bp, Homo sapiens
tgccgtctctgcctgctccatctggctgatcccaggcaggcagctcagctctcagcagacacagatccccagcacatatgaacgtgaaagaggcttctccrtgggagcgaagtggccagcaggtgtcacaggctgtgtgggcccagcatcgtgtgggcactgctgggggaatcccatcacagcatgtgctggcgttagtag

SEQ ID NO: 2208 - DNA, 201 bp, Homo sapiens
ttttagtttgttcaccacgcttgatggcagatttgcctctggatcctcaggccacgttcctatggtgggtagggatctctctctctctctctctctctgtstgtgtgtgtgtgtgtgtgtgtgtgtgtgtgtaaatagtgatttctctaagttaataaagaatgtggggtgacctcctacacatgcccgtatgctattgtg

SEQ ID NO: 2209 - DNA, 201 bp, Homo sapiens
ttgggcttagtagtaaaaagggggaacaaaataaaagaagatcaggagacaaagagcctacagtacaaaaaaggaaagacgaaggttgatattattagaartacttcctgggcagccttactgtttgaattaggatcacccccacccccacctcccagaggtattagttgtaatgcagagacaaatggaaactagtcagat

SEQ ID NO: 2210 - DNA, 201 bp, Homo sapiens
tttttgagggggaaaaatacagcaaggggaaatgttttattaacaataaatatgcggcttaccatatctgtagggcacagatttggttagtagtattttgraggcaggataaaggaagatcctaaaatctctgtgctgtgtagcttccattcgagctgcacatgttaaaaacattctaggatccacacagtttaaacaagg

SEQ ID NO: 2211 - DNA, 201 bp, Homo sapiens
tcaaagagaacaacaattcaccacaccccaacatggtaacagtctttttgttttagaagcatctgtgaattgccaagactcgtagaactaagatgtattcraagtcagtcgattttctggaaacgacccagtccctgaagatagtcttttggggagttgagtgttttgagagggacaccccctctacagggacttaaaatg

SEQ ID NO: 2212 - DNA, 201 bp, Homo sapiens
tcctgcatagaaatatttatttattcattcattcatttttttgagacaggttctcactctgttgcccaggctggagtgcagtggtgcagtctcagctcccwgtagcctcaacctcctgggctcaggcgattctcctgcctcagccccctgagtagctgggattccaggtgtgtgccatcacacctggctaattttttaata

SEQ ID NO: 2213 - DNA, 201 bp, Homo sapiens
tgtgtgatcgcattggagctacttcaaagagcaaacacaccactttgatttatttctcttagtgatacagtatttagagagggagatactttttatcttcrtgggatacttacagtggtgctctagaagccatgtactgcttctggcttctccttcctttcctccaaggctcctcctgcctcctcccaaagctctgtgccc

SEQ ID NO: 2214 - DNA, 201 bp, Homo sapiens
ttagtatcctcaaattatcttgaaatcctcagagatctgaaatactagtactgactgtacagttttcttactcaaatctatagcatgtggaaagttgacakcaagccatgccatcgcctcctggtattctctgtgggtttaaggaagcagcatcttatattctttggcttagagttcccccaaagcacgttctgtctaagg

SEQ ID NO: 2215 - DNA, 201 bp, Homo sapiens
aatgtttggccagagtaatccatccttactcatcctctccatgtgaggtttttgtttctttttaaagaaggctacaacacaacacatactactctgaagtygaattcaagagccccgcgccccacctgtggcaggcctgagggagccgccgcagtgagtgtgcacacagctgcatggccaggactccggcatgcaccacgt

SEQ ID NO: 2216 - DNA, 201 bp, Homo sapiens
gcgaagaaaagtggagagagaacaaccttcatgtcttgagccttttgtgacttctcctagactctgttgggagcttttcctgtgtgatcacatgacattcmcccatctaagcagccgaggcttattcctcccgactgcagccctctttgatctccctcttccttcctttgccttctatatccaggtggctaccccggtcta

SEQ ID NO: 2217 - DNA, 201 bp, Homo sapiens
tgcctcatctgccctttttggtgagaatgtcctttttgtgatgactttatgcactcccttttgcttttcggttgttccaagccccattcaaatccatgacraggactctgctctctgatgggcaggaccttgatgaggccacaggtgctcactgctgagtgggaggaagcctgggtgggctccagggacctgcagagtgta

SEQ ID NO: 2218 - DNA, 201 bp, Homo sapiens
gaggaagtgacggggactaaagggcgccaaagcaaaggggacataaacaccaggaacaacggggagagagcctcctgtgagtgacagcatccaaaacaccrtgggcccaaccatcatgataacagcagaccctcctcccatgtgtgatggcagctttcctctgcggcccctcctggtttcacatgggggaccactagacca

SEQ ID NO: 2219 - DNA, 201 bp, Homo sapiens
ttttgtggttggtgtattctgaaccctccgctgtgtgagcagcccgctcaggggcagtgtacgtggctgatctccactgtcctgcccgcgtggatgggggsgttattctcagtgtacgtggctgatctccactgtcctgcccgtgtggatgggggggttattctcaggtcagcccagtgttggcctccctccctgggaacc

SEQ ID NO: 2220 - DNA, 201 bp, Homo sapiens
agtccctgggcaagtagccagcgtaactgattgacctaaaacaaaggatggagcccttggggctctgcatagtgaaatgtatgatttcttagtggaaaacragaaagccactgaggaagcccagaagggaacttagcatatacagccagctttggggaagggggaagcagtgccaagcaagacaggtgcttttcagagaca

SEQ ID NO: 2221 - DNA, 201 bp, Homo sapiens
catatacagccagctttggggaagggggaagcagtgccaagcaagacaggtgcttttcagagacacatgaatctctgtcactcacggatgtactctttgcmccaggtgaaagtgacgtcctgcatttcacctccaccaccacgtcgaagaatcgcatcatcataacctggcaccggtaccggccccctgactacagggatc

SEQ ID NO: 2222 - DNA, 201 bp, Homo sapiens
gagcagatttggggagatgttagtcaaaggatacaaaatttcagttagataggaggaataagttcaatagatatattgtacatgatgacagtaataatgakgtattcttaaaaattgctgagacaatagattttaagtgttctcaccacacacaaaaaaatgtgatgtaatacatatgttaattaggctcattcagctgtt

SEQ ID NO: 2223 - DNA, 201 bp, Homo sapiens
gaaggaggccagttactagagcagagtggccgtagaggctgcaacacggtggccaaagcatgaagctgctgtatagtggcaaggtcacagtgatttccccrcagcctcggtttagagggagacggggtgtgctgagctgtgcctgcttctgtagaaggggccttctccaagtctgagtagccttaagccattaggactgct

SEQ ID NO: 2224 - DNA, 201 bp, Homo sapiens
atgcatccttttttacttcagagtaagtcggccttggttaagtcttaatatttctcatgcctatttttttttcttcaaatgaaaacatacggagagaaaayagcatgtttatgccttttggttgtacccagcactgcccagaatggcttacagagtttatacccatggaggtttcgtaaaggtgacattaacttcgcagta

SEQ ID NO: 2225 - DNA, 201 bp, Homo sapiens
cttcagtgcagtggcataatcttggcccacttcagccttgacctcccaggctcaagcagtcctcccacctcagcctccctggtagccgggaccacaggtgytttgccgccacacccggctaattttttattttttttgtagtttttgtagagatggggttttgccacgttgcgcaggctggtctagcattactgggctcaa

SEQ ID NO: 2226 - DNA, 201 bp, Homo sapiens
tgaaaggttagatctttgttctgagataaattaagtggaaaaaggtgtagagcattatatgtactctgattcttcagggcttaatttaaaaagagcatgtwtgctggtgaatgctggttcaatcattaagaagtttttgagaaggaatcccagaaagtaataagcacttatttttcatggaaaggaaccggaagtgcttgg

SEQ ID NO: 2227 - DNA, 201 bp, Homo sapiens
gtagaaagcaagaggattttccttgcagtcactgaaggtaccttgtgtacacagaaagaagacagagggagccccggatgcctcggtatccctcagagccrgatccttcagacctgtgcagtacctgtggatttggttagtcgatgatgcgctgccattaaaacaaaggcatcggccctggaatagagaagttcagtgaga

SEQ ID NO: 2228 - DNA, 201 bp, Homo sapiens
gaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcg

SEQ ID NO: 2229 - DNA, 201 bp, Homo sapiens
gaaaagcatctaacatgtttccaagcacataggtttttggtaaatggtggcagctgctgctattttttttttaaattaaactatctaagagttgcattctragaccatctaaaattctgagtcttaagctgtgttgactatatatgttcactaccataactaaatggtccttctgtattgcttttctaaattgtagaattt

SEQ ID NO: 2230 - DNA, 201 bp, Homo sapiens
gcagaagaacagaacagtccttggagcttggtaggaggtgtgagggcttatgggggacagttgtcttttcaagtcaaggaggaataagggcttctggggcsggtggaaagggtgagtcttaggcagggaagggtgaccatccaggttagatcacttcttctgcggggtcagcttggccgctgttaggttttcaggatgtca

SEQ ID NO: 2231 - DNA, 201 bp, Homo sapiens
tggggaagggggaagcagtgccaagcaagacaggtgcttttcagagacacatgaatctctgtcactcacggatgtactctttgccccaggtgaaagtgacrtcctgcatttcacctccaccaccacgtcgaagaatcgcatcatcataacctggcaccggtaccggccccctgactacagggatctcatcagcttcaccgt

SEQ ID NO: 2232 - DNA, 201 bp, Homo sapiens
cctaaggggtgtaaggaactccagaggtcatctggttcagcctgctacagggcaggaatctccacggtagcatcgcagaccctccactgtccttttaaagyccccacatgcattggaaatgtacggtgctcaccctttggtacagagactgaggaatgtgagtttatgctcaagtcattaacaagacagaattcttaggct

SEQ ID NO: 2233 - DNA, 201 bp, Homo sapiens
ttttaagtgttctcaccacacacaaaaaaatgtgatgtaatacatatgttaattaggctcattcagctgttctacaatgtatgcatatttcaaaacaataygttgtacatgataaatatacaatttttatttgtatattaaaattaattaattttaaaaaagatctccagtagtcacctggtcagcaccagatattctaat

SEQ ID NO: 2234 - DNA, 201 bp, Homo sapiens
attgattatttgtttatttagacctcccattatagaaagtgtgacatgctgggcctctggggaagatttttgagggttttgatgtcagagccccgaacttyctctgaacttaattgtctttcagaccctttaagaatgtcacagagtatgatgggcaggatgcctgcggctccaacagctggaacatggtggacgtggacc

SEQ ID NO: 2235 - DNA, 201 bp, Homo sapiens
tggtcttagacttgtagcaggactcaaatgtctgcagcggcattggaaaggggtgccgtccagtgtgtgcatgtgtgtgtgtgtttattttaaattgtctrtggaactatctcaaagattgaggccagcaggacttgacctatacatagatgtagactgtacatagatgtaagaatttctattcattttatgaaaatgaat

SEQ ID NO: 2236 - DNA, 201 bp, Homo sapiens
ggatctgggagcacggtgctaggactctctaagcgtgacctccttcagtttggcccagagtggtcagatagtttgccggggcataggatggatgacaggcytcatacgcatcacgtctgaagggaaagcccttgaattttccacgctactttttagtaacagtaggctttgtcataattggcttcatgttccagctttcct

SEQ ID NO: 2237 - DNA, 201 bp, Homo sapiens
ttaagtgttctcaccacacacaaaaaaatgtgatgtaatacatatgttaattaggctcattcagctgttctacaatgtatgcatatttcaaaacaatatgytgtacatgataaatatacaatttttatttgtatattaaaattaattaattttaaaaaagatctccagtagtcacctggtcagcaccagatattctaatct

SEQ ID NO: 2238 - DNA, 201 bp, Homo sapiens
agaaagaattcggggatgatttcagagtacactagaatattttttaaaagaatattttataaaaatacagtgatagtaaaagaagtagaaggccaaattcygcccccagccccttcttaatattggactttattcctttgcttttttcccttgctgccatctaaggaggctttctgtgctatagcatccagttcctctgcc

SEQ ID NO: 2239 - DNA, 201 bp, Homo sapiens
atataaccatatgtaagtgactgtgctatcaggagacagaacaacaagacccagaaagactcagtgacccacagagccagttccacccaaacaagtcttastaatgagattagataatgagagtgtattttcttcatcaattcatgtagctcagcaaggctggaaactgcttgcacacttctgcagagaaaaaaaaaagtt

SEQ ID NO: 2240 - DNA, 201 bp, Homo sapiens
ttttacagatgggaagagagaggatcaagatcacagaagctaatggtttgtcccagaccaaacaaggagttcctaggagagactgaactttaaagatatcractctctgcaggtctaagtggatgaaaggacagtggtgggggtgaggatttcgtagtgtgtttttgcattgtctcctcaatgagtgatctggtgctggtg

SEQ ID NO: 2241 - DNA, 201 bp, Homo sapiens
agctttgtgcacactgaacttggagaaccactgtgttggactccgagtcctcttgcctggatgagaggcccaagagcactgcatgttagtggctcttcctyctcccccacacctccagggactggagctggggctgctcagaatgaaagatgaatgggggagggagaaggcccagggttgaccccccacaagcttgtctcc

SEQ ID NO: 2242 - DNA, 201 bp, Homo sapiens
gagcactgcatgttagtggctcttcctcctcccccacacctccagggactggagctggggctgctcagaatgaaagatgaatgggggagggagaaggcccrgggttgaccccccacaagcttgtctccctgtctcatgctgtctcctatcccatcatgctgctgattgggcaggatttacttccatggataatgggagact

SEQ ID NO: 2243 - DNA, 201 bp, Homo sapiens
ggctaacatatggctttaagctggatgttacaatgagagctggagtttcgtctgattgcacatagccttgcttttctgtctttggaaaagtagctcactgyagagccctggtaaacgtttgaactgcattgcgggagtaggcagaagaacagaacagtccttggagcttggtaggaggtgtgagggcttatgggggacagt

SEQ ID NO: 2244 - DNA, 201 bp, Homo sapiens
gagcaggctgtttaaatcacattttaagtaaaaaccaaagtgcacagatgatctgcagaacttctgggggataagaagctgctttcctcgaagaagttcayctccaaaccagcgcccatggctcagcagccagcatggcagccccaggggtacatgggacttgggcatgtgaggctggtgagggacagggacagctgggtc

SEQ ID NO: 2245 - DNA, 201 bp, Homo sapiens
tggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagca

SEQ ID NO: 2246 - DNA, 201 bp, Homo sapiens
aagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctc

SEQ ID NO: 2247 - DNA, 201 bp, Homo sapiens
aagctttcagaaccactgacttgtggtgatttttgcatgccaagtatttggaaaatatctggagccccttcagctctcaccagttaaacctatttgtacawttgttctggtttcttcctgtgcttgaaaagcctctttctttgttgcgttaatacctctgtcttgctttcctcatgtgtatgccagtgtgacattctcggc

SEQ ID NO: 2248 - DNA, 201 bp, Homo sapiens
ttgctgtggaggctttctggtatttcatttcaggtgcagatgccttcactttcccacaaaaaaaaccccaacaaaacctaagaccttactgcaactaagtytccaagtactttttaacccaatgggatgaacagcctgtggtctgctcagatcaccctgagtgcgtgtgagaaggcctgggctttgccaggaaatccagga

SEQ ID NO: 2249 - DNA, 201 bp, Homo sapiens
tctgggggataagaagctgctttcctcgaagaagttcacctccaaaccagcgcccatggctcagcagccagcatggcagccccaggggtacatgggacttsggcatgtgaggctggtgagggacagggacagctgggtccagcagtgcctttcctagggacggttgccacgtcacctgtctgccctgtacttccatttcct

SEQ ID NO: 2250 - DNA, 201 bp, Homo sapiens
tgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagta

SEQ ID NO: 2251 - DNA, 201 bp, Homo sapiens
cttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgcc

SEQ ID NO: 2252 - DNA, 201 bp, Homo sapiens
gtgagctggccctgacttctctccagtatcatcattttctaggaaagccatttccccacaacccccaaggaaagcatatcataaacaagttttcccttggrgaggttccctcgactcccttctctcctctcccttcctctctgaattgttgccatatgtgaagtccacttttctagttgtcatgctacctgttgacactaa

SEQ ID NO: 2253 - DNA, 201 bp, Homo sapiens
ccggcattgttggcggtccttgtctttgccactgggaatctggtttcctcagactctacgtccacgtttcaggattgatccagagtcagtgtcctgcttaygcttttgaatgaatgatcccacctcagctgcaggatttctgcttagtttcctaaaaatttcactttgggttatgagcttccaattctaaacctgctaaag

SEQ ID NO: 2254 - DNA, 201 bp, Homo sapiens
tgggagataaatgctgagacataaagccagcaagaactgagttttcatttggttgcctccgtgggtctgaagtctttgacccttactttgctgcttactgrgtaagcagtgtgtctgcttttattccttagaagcagtgacttccccttctcggcccctttggaaattcttttgctgttcttcatttgggcttaatttttt

SEQ ID NO: 2255 - DNA, 201 bp, Homo sapiens
gcctgagtcatgaaaccggaccacattaagggcgacacatggtccaatcactgtttgtaaaagtccacgtatttcaaactcctctctcctgccactgctgrgctgtttccctctttgaggacctggtctccgcagcatttattcattagatggcagtcctaggggagtctcgctttggggaaacctctcctcctgcacatt

SEQ ID NO: 2256 - DNA, 201 bp, Homo sapiens
ctgccactgctgggctgtttccctctttgaggacctggtctccgcagcatttattcattagatggcagtcctaggggagtctcgctttggggaaacctctsctcctgcacattcaagaaaacaaccgcggagacttagggtcggtactggtttccagtcacttacgtagcaaacgaagcaagaggaacgtgcctgggagga

SEQ ID NO: 2257 - DNA, 201 bp, Homo sapiens
tatttgtctagcatcattgaaagagttttttgcttgagttgatttcccaggtaattgaagcttacttctcaaagcacaagatattttttctcatatattarcggtcttaagtgagtgagacccctaagaattcttaattcctttatcttacttttcctacaggaaacttattatgttttcctagataggaattgtgctacc

SEQ ID NO: 2258 - DNA, 201 bp, Homo sapiens
acatgccgtttgaatgtataccatgaagaccccttagctcagggagctttgctctatttaagtaatgtttatattcttaatgaaccaaagaggaagtggtyatgggaaaagagccaggactagatttcattctaatgcttataaggagagttctaggaaaccctcagacttggtaaaccaaggcatttggagatactatga

SEQ ID NO: 2259 - DNA, 201 bp, Homo sapiens
gaaaagcttgatgaaataggtgactggagatctggcagagtatttcttgccagcatcgattgaggcacctctgaaaagtccaaaactcactcccttcctcyccagtttcaggcacagaataaaaattcagaacacatggccttggtcctggctctgtggctggctgcctgtggtcctcagacagctgctgcaggttcctgg

SEQ ID NO: 2260 - DNA, 201 bp, Homo sapiens
gccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggca

SEQ ID NO: 2261 - DNA, 201 bp, Homo sapiens
ctgggtttgtgcccttcgtgctgcactgacaggtcaaagccgactcaggcctttgatgtctgctctaggagcaaaagtgattcctggtcccgcagccgttyccactgccttgtgtatgaaggtctgctgctctgaggtggatggtggctctaggcaggctgtttccgctgggtgcggttgttgctgcaggtttttctatat

SEQ ID NO: 2262 - DNA, 201 bp, Homo sapiens
gtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactga

SEQ ID NO: 2263 - DNA, 201 bp, Homo sapiens
ccaccatgttggccaggctggtctcaaactcctgacctcagatgatccgcccgcctcagcctcccaaagtgttaggattacaggtgtgagccaccatgccygactctttttaattcttaatgtggctacttgaaaatttaaaattacagatgtggcttgcattctgtgttggtaagctgctttagagcatttcttttaaca

SEQ ID NO: 2264 - DNA, 201 bp, Homo sapiens
gcgaaggtgagtctgggagagacgccatggagtcagtgtgagttctgcagcctcccaagttccgctggcgtgagaggcttgcctggtgccagggctctggrcattgggaacattgcctggtctaccgggcaagaaacgtgaaccaccgcagtgaactggcagcgcgttggcatttttccctccatgtttttataaaaccgc

SEQ ID NO: 2265 - DNA, 201 bp, Homo sapiens
gtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagta

SEQ ID NO: 2266 - DNA, 201 bp, Homo sapiens
aggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaattttttt

SEQ ID NO: 2267 - DNA, 201 bp, Homo sapiens
ctcgacaattcacaactcttttattagctatcttaaaaaaatttattactggcatcaattagcctgagtcatgaaaccggaccacattaagggcgacacayggtccaatcactgtttgtaaaagtccacgtatttcaaactcctctctcctgccactgctgggctgtttccctctttgaggacctggtctccgcagcattt

SEQ ID NO: 2268 - DNA, 201 bp, Homo sapiens
ttaaatttcacctgcctgtttcctttttattcttttttttttttttttgaggcggagtttcgctctcatcacccaggctggagtgcagcggcgcgatctcrgctcactgcaacctccgtctcctgggttcaagcgattctcttgcctcagcctcccaagtagctggaattacaagcatgtgccaccatgcccgtctaattt

SEQ ID NO: 2269 - DNA, 201 bp, Homo sapiens
tttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattggg

SEQ ID NO: 2270 - DNA, 201 bp, Homo sapiens
atagagcagtcccttgattctgctttgtccccattaatgacagatctgagggcatccagaaggaatctccacaagcccagcctccacagtggctgcttccyctacatggtagagtggtgctcacctccactcctccatagatgccaagtcatctgtggtatagatgtggatgtctttgttcaaatggtccttgagtctttg

SEQ ID NO: 2271 - DNA, 201 bp, Homo sapiens
ctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagc

SEQ ID NO: 2272 - DNA, 201 bp, Homo sapiens
ctgctgcgggataagggccagggcagaggtgtgaacgcagccgtggaagacttgggccaggaagccatttgttctgctgctaacacttccacagctccacrtgtccagactgttgccagagacgtctttggtctacaggattcaggagggaatctgaactttagcctggagcattatcaactcatagatgagtctgaaaca

SEQ ID NO: 2273 - DNA, 201 bp, Homo sapiens
cgctgggcaccaccgggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcatttt

SEQ ID NO: 2274 - DNA, 201 bp, Homo sapiens
ttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctc

SEQ ID NO: 2275 - DNA, 201 bp, Homo sapiens
catgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaa

SEQ ID NO: 2276 - DNA, 201 bp, Homo sapiens
gcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaa

SEQ ID NO: 2277 - DNA, 201 bp, Homo sapiens
ttgcttttgggcgtacgatttggaaatgtagttgtttaccaaaaaaaatgatgtatgggccattgtgcttcccctgttcctgccttccagataatgttctstgtcacctccctccccttgtcactgccttgatgtcatcagcattgagagctgtgcagtccctaaaagtgtgatgttgataaacaagtaaactactgagta

SEQ ID NO: 2278 - DNA, 201 bp, Homo sapiens
cgtacgatttggaaatgtagttgtttaccaaaaaaaatgatgtatgggccattgtgcttcccctgttcctgccttccagataatgttctgtgtcacctccstccccttgtcactgccttgatgtcatcagcattgagagctgtgcagtccctaaaagtgtgatgttgataaacaagtaaactactgagtatacttcatgaa

SEQ ID NO: 2279 - DNA, 201 bp, Homo sapiens
tgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctc

SEQ ID NO: 2280 - DNA, 201 bp, Homo sapiens
tgttggctttgaagaagaatgatgctgtgcttgcctttgcagtcctgtcaccatacttcctggaaagtgggtggacacgctggatggtagatgttgagttstttagatgcctggatgcttacatgctttgtgtgggttcttactggggctgtaacttactagaggacagactccaacttctgcttacttagtctggggagg

SEQ ID NO: 2281 - DNA, 201 bp, Homo sapiens
cccaaatctctacccattggtcaaggtccctgagttcacagagcccaggccagagccctggaaacgcctctgcccgtccgctgcctaattgcctgtccacrctgggcaccaccgggtctctccctcagtctcagagctcagttgcttctgcacctcatcagggatccagccatcaaagccaaggctgggggacacttggac

SEQ ID NO: 2282 - DNA, 201 bp, Homo sapiens
aactcctggactcaagcagtcctctccctccagcctcccaaagttctgggattacaggcatgagccaccatgcccggctggaactgttggctttgaagaaraatgatgctgtgcttgcctttgcagtcctgtcaccatacttcctggaaagtgggtggacacgctggatggtagatgttgagttctttagatgcctggatg

SEQ ID NO: 2283 - DNA, 201 bp, Homo sapiens
tcaaactcctggactcaagcagtcctctccctccagcctcccaaagttctgggattacaggcatgagccaccatgcccggctggaactgttggctttgaaraagaatgatgctgtgcttgcctttgcagtcctgtcaccatacttcctggaaagtgggtggacacgctggatggtagatgttgagttctttagatgcctgg

SEQ ID NO: 2284 - DNA, 201 bp, Homo sapiens
ggtggtggacgggctgtgtggtctcccctcagctgtccacttgcacttgtgttaaaatgcggcagaactttccctctatacttaaattgtggtgaaatacrtatgacataaaacttaccatcttaacttttttttattgagacaggatctcattctgtcacccaggctggagtgcggtggcgcgatctctgctcactgcaa

SEQ ID NO: 2285 - DNA, 201 bp, Homo sapiens
ctacaggttttcaagtcatctcgtgtggtgcacagtcctcgccctacctcgaaggcccgggcgaagttttcctgagtgtgtatactcatctctttgtgttrtctctggcagggagcaagtgagtacaggattggagtaataggcatttttaggcttgagatggctttgtgtgtttggttaatgtcactacatttcctaggg

SEQ ID NO: 2286 - DNA, 201 bp, Homo sapiens
gcttgcctgccttttgggtcgtctccacctcccagggatgtttttgttccctgatcgaatgacctcctgttttgtttgttttttgagacggagttttgctytgtcacccaggctggagtgcaatggcatgatctcggctaactgcaacctctgcctcccgggttcaagtgattcttgtgcttcagccttctgagtagctgg

SEQ ID NO: 2287 - DNA, 201 bp, Homo sapiens
gcaagtccctataggataggcatgtggtacagtgtgaagctcctgagtggtcaacagctaccccgtgacaacatgccacactccatgtgccactccctccygcctgcctgctgtgtccttggccccagtggtgctctcccgtgctgaccagccggcacggctcacctggccgaactctagccttgccttttcctctcaagg

SEQ ID NO: 2288 - DNA, 201 bp, Homo sapiens
ccattggtcaaggtccctgagttcacagagcccaggccagagccctggaaacgcctctgcccgtccgctgcctaattgcctgtccacgctgggcaccaccrggtctctccctcagtctcagagctcagttgcttctgcacctcatcagggatccagccatcaaagccaaggctgggggacacttggactagagtaatccta

SEQ ID NO: 2289 - DNA, 201 bp, Homo sapiens
tactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttca

SEQ ID NO: 2290 - DNA, 201 bp, Homo sapiens
cttagcattggttacagaaataattaagacaatgtcttcaggagattttgacttgggaataaaactcactgtccaaccttgcattcatccctccaattttyctagcttttaaggagcattgctccccttccagggacccacattggtttctaagaggcaagctgccctaatgacgaagcctctgcacggagcaggagcagt

SEQ ID NO: 2291 - DNA, 201 bp, Homo sapiens
gtgttgtcaataaacaagtccattttaaaagcatctttgaaggtgtgtaatgaaaatggaggccttaggttgtatcagggtttatgaggagccagcttatmtgtaatcagatgttcctgttactgttatcactgtagtatagggcttagttctgccctttaagtcacagactcaagttactcctgattttaccagcagtca

SEQ ID NO: 2292 - DNA, 201 bp, Homo sapiens
agttggaatgcagtggcatggtcatggcttactgcagcctcaacgtcccaggctcaagggatcctcctgcctcagcctcctgagtagctggggtcacagakgtgtgccatcacgcctggctaatttttaacattttttgtagagatgggagtctcactatgttgcccaggctgcactcaaactcctggactcaagcagtcc

SEQ ID NO: 2293 - DNA, 201 bp, Homo sapiens
gacttgggaataaaactcactgtccaaccttgcattcatccctccaattttcctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctca

SEQ ID NO: 2294 - DNA, 201 bp, Homo sapiens
ggaaaaaaaaatgtattcagccagtactctttccaggttatagctaaacgtcagttggcaacctctatgctgtggtttattgagtaacacttaatacttarcacagccctcagtgaagatcttttatggccttttctgaatgttatacaaacataactaaagcttatccagatgaggacagggacctttctttccttcctt

SEQ ID NO: 2295 - DNA, 201 bp, Homo sapiens
agtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattt

SEQ ID NO: 2296 - DNA, 201 bp, Homo sapiens
ggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttatt

SEQ ID NO: 2297 - DNA, 201 bp, Homo sapiens
tccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttctttta

SEQ ID NO: 2298 - DNA, 201 bp, Homo sapiens
gcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacac

SEQ ID NO: 2299 - DNA, 201 bp, Homo sapiens
agtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgat

SEQ ID NO: 2300 - DNA, 201 bp, Homo sapiens
ctgcaagagacttcctgggagggtggtatcatttggcctgtgggcttttgtaacactttcctgctattaggagagtgaattctgaattttcaatcacgttsacctgttggagcaagtagagtttcagacggtctccgcttttctcgactagaaagcaggccttctcccttttccccccagtcttgtttcatgacaccattc

SEQ ID NO: 2301 - DNA, 201 bp, Homo sapiens
ccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttcacctgttggagcaagtagagtttcagacggtctccgcttttctcgactagaaa

SEQ ID NO: 2302 - DNA, 201 bp, Homo sapiens
ggggtgcagtggcatgatctcagctcactgcaacctccaccacctgggttcaagcgattctcctgcctcagtctcccaagtagctgggattacaggtgtgyaccaccatgcccacctaatttttgtatttttagtagagacggggtttcaccatgttggccaggctggtcttgaactcctgacctcaggtgatccacccac

SEQ ID NO: 2303 - DNA, 201 bp, Homo sapiens
gtggcatgatctcagctcactgcaacctccaccacctgggttcaagcgattctcctgcctcagtctcccaagtagctgggattacaggtgtgcaccaccaygcccacctaatttttgtatttttagtagagacggggtttcaccatgttggccaggctggtcttgaactcctgacctcaggtgatccacccacctcagcct

SEQ ID NO: 2304 - DNA, 201 bp, Homo sapiens
ttttcacctttggcttttaataagggaagggtattagaaaaaaagtaatttgtatgatgaagggtgatttgtgcgtgtgtgcagacagacacacatgcagrgaggcaaatcagaaccgatgcgtgtttggctttggcttgtttcgctggtgtctggatttacctggcgacacttgttgctctgggggatcttagagggaag

SEQ ID NO: 2305 - DNA, 201 bp, Homo sapiens; identical to SEQ ID NO: 250

SEQ ID NO: 2306 - DNA, 201 bp, Homo sapiens
accataattctgtgctaagtcagaattaatgttattttgttaattcaggttattgtgaaaatctccacaggaggttatttaagcaagtcacaaattgatgwttctgtttgtagaaaaactccagctcatccagccagccacattattccagggctgcatggtgtcagcgtagggaccaggctcggtgtagagaccaagggt

SEQ ID NO: 2307 - DNA, 201 bp, Homo sapiens
ctgtggaatcatttgaaaatttctgaaaacatgaaacaggtgtttataaggagttttctgacttaacaaaattggtgaaataccaactttactaaaaactrctaattcataattttttgattaataatttctagtctggaaaagaggaattttttgaaaatcactgatatttttgatatactgttgttttcaaattgagtt

SEQ ID NO: 2308 - DNA, 201 bp, Homo sapiens
gaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgcgcatgtgctggcagtataaccccaagatgaggccttccttcctggagatcatc

SEQ ID NO: 2309 - DNA, 201 bp, Homo sapiens
ctaagaaggtgggactccagcggcaatgccttgtccatgtgctaagccagccgagggcgcacgaagtgctgtgtggtgtccaagctgacttgggagggacmagtttggggccagccccccagcctcacttgtcatgtcccacctctgctggcatctgtgggcttaaagtgccttcactcccatccttttcaactatttctt

SEQ ID NO: 2310 - DNA, 201 bp, Homo sapiens
accatagataacagctgtcacgatggacagtgtggacctggattagtccttcttgggaaaggagagtttgggttttgtaccgtggtggttctgggttctgrgggaagagaatggaaccgtacgaggtaaaacaggagactctgaaggccacttggccatccaggcagaaagccagggatggagaggggcagcagggctgtg

SEQ ID NO: 2311 - DNA, 201 bp, Homo sapiens
tgccttgtccatgtgctaagccagccgagggcgcacgaagtgctgtgtggtgtccaagctgacttgggagggaccagtttggggccagccccccagcctcmcttgtcatgtcccacctctgctggcatctgtgggcttaaagtgccttcactcccatccttttcaactatttcttgattaaaaaaaaaaaacaaaaaactg

SEQ ID NO: 2312 - DNA, 201 bp, Homo sapiens
tagcactgccaccatagataacagctgtcacgatggacagtgtggacctggattagtccttcttgggaaaggagagtttgggttttgtaccgtggtggttytgggttctgggggaagagaatggaaccgtacgaggtaaaacaggagactctgaaggccacttggccatccaggcagaaagccagggatggagaggggcag

SEQ ID NO: 2313 - DNA, 201 bp, Homo sapiens
tttgtttcttagcactgccaccatagataacagctgtcacgatggacagtgtggacctggattagtccttcttgggaaaggagagtttgggttttgtaccrtggtggttctgggttctgggggaagagaatggaaccgtacgaggtaaaacaggagactctgaaggccacttggccatccaggcagaaagccagggatgga

SEQ ID NO: 2314 - DNA, 201 bp, Homo sapiens
aaggaggcaacttggtttcatagggagtgtcatgttgtccttctgagtttactgatgagcttacctgagaaaggagggttctagcatgggagttctgttgytacaagacatgaaagaatggcctccgtttatcccggagaggagagtccctgagcccttgggagttgccttgaaacctctgccgggtcccaggtgagaaag

SEQ ID NO: 2315 - DNA, 201 bp, Homo sapiens
ggagccccggccacagccggcaggactccctttgctccatgtgactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggct

SEQ ID NO: 2316 - DNA, 201 bp, Homo sapiens
gcccactgatccaggaagagattcctttgacctgggaagtcataatggcagatatttagacccagctctcaagcaagcctccaagttgttccggtgaaccygtaactttgagtaacctctgattgaaccagagagtaggaactaggtgcagaaccttgttgaatagaattgtttagcatcgtccatttgttagagcatttc

SEQ ID NO: 2317 - DNA, 201 bp, Homo sapiens
aggagagtccctgagcccttgggagttgccttgaaacctctgccgggtcccaggtgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtg

SEQ ID NO: 2318 - DNA, 201 bp, Homo sapiens
gttagggtattctccttgaggagctcagaataaccaaaggtaaagcatttggtggtataagatatattcatcttaaaaataagttgaaaataataagataytgggagatgttagccaccgaagtaaataactacagtgaaatagctctttattaattttgaaacctaaagttgaaagagttccgtattatttgtcagtatc

SEQ ID NO: 2319 - DNA, 201 bp, Homo sapiens
cctggctttcaggaaacgtagtgacgtaaaaggtcccggctgctgcgggataagggccagggcagaggtgtgaacgcagccgtggaagacttgggccaggragccatttgttctgctgctaacacttccacagctccacgtgtccagactgttgccagagacgtctttggtctacaggattcaggagggaatctgaacttt

SEQ ID NO: 2320 - DNA, 201 bp, Homo sapiens
gaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagact

SEQ ID NO: 2321 - DNA, 201 bp, Homo sapiens
agaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaa

SEQ ID NO: 2322 - DNA, 201 bp, Homo sapiens
tatcataatatgccacctactctggttgtgtcttacaactgtagctctgtggggttttttttgtttgttttatgcttgctaatgggggaggtggggggtgkgggcggatgaatataaatgatacctagaaattgaaattggaaaaaaaaatgtattcagccagtactctttccaggttatagctaaacgtcagttggcaac

SEQ ID NO: 2323 - DNA, 201 bp, Homo sapiens
tgggatcctcctggaggcttagtagggctgccctgagcagtattgtcttctccagctgggcctctgagctgtaccatgtgcccgtgctcagcctcagtccmtccctcagccagttgttaaatcactttggacgtgtgacagcctcaacatgtcacagctttaaaagttcagattttaaaaaggtaaggaaatgatctccta

SEQ ID NO: 2324 - DNA, 201 bp, Homo sapiens
tggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcct

SEQ ID NO: 2325 - DNA, 201 bp, Homo sapiens
tctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacataggctgggagtctgctctcttccagcctggtccctctcttctttcagccc

SEQ ID NO: 2326 - DNA, 201 bp, Homo sapiens
aataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgta

SEQ ID NO: 2327 - DNA, 201 bp, Homo sapiens
ggtttgactatcgagtttagattttaaagttgaggattgtttctttaagaagaaatatagaatattattcagtcctaaaaaggaaggacattctgacacawgcaacagcgtgaatgaaccttgaggacattatgccaggtgaaatcagccagtcacaaaaggacaaatactctatgtgatttcatttagatgaggttccct

SEQ ID NO: 2328 - DNA, 201 bp, Homo sapiens
gcccagccagattttatttctttaaaaaagaaacttactagttatcaggacacttgtgttcttggtacttgattttgtcagcattatttttaagagcctcktccctccttccccctacctccctgttgagcccaggctctgaaataacataggtgcatgtgaagttcccctacctgccattaccagacattggtgctgggc

SEQ ID NO: 2329 - DNA, 201 bp, Homo sapiens
tgtaacatgggggtatattatagtcagtagcacctgcttcacaaactcgtgaggacttcagcagttcacacacataactgcctcgctgcctggcacctagygtgcacatggcattctaccgtggggtagacttttaaaattctggctacagagatacttttccataaaagtggccacatggaactctccaaatctaagaag

SEQ ID NO: 2330 - DNA, 201 bp, Homo sapiens
tgcctggtcatgcagagacggagctgggagcagctgcatgacttttcagagaagtggcacacgtttactgtaagggtcccaaatgtagaccactgcagatsgtaaggtctagatggagggaccaatagtagggaagtaggggagaagaaagtaaaaccttacagtataaagacccatagatgctcttttgtttttgatgtg

SEQ ID NO: 2331 - DNA, 201 bp, Homo sapiens
gagggaccaatagtagggaagtaggggagaagaaagtaaaaccttacagtataaagacccatagatgctcttttgtttttgatgtgtgtacgggggttagrtatttattgagcacctactgcatgacagagtgttcagcaatgacaatgcagagcttaataagaacaggttctagactaatcttttagggggtgaggatag

SEQ ID NO: 2332 - DNA, 201 bp, Homo sapiens
ccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaa

SEQ ID NO: 2333 - DNA, 201 bp, Homo sapiens
aaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagg

SEQ ID NO: 2334 - DNA, 201 bp, Homo sapiens
cagcaagggcataggtacctgccattgtgcaccaaagtccctttcctcatggccctggctgttctcctgcatggggtcatgtgtgtcccgttaccaagttrtggccccttttcaaccttgagtgccacatctgggctgttgtaggcatgggtagtacaagctgggtttgttactctaaaaatgaaagggaggatcagttgt

SEQ ID NO: 2335 - DNA, 201 bp, Homo sapiens
gctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtg

SEQ ID NO: 2336 - DNA, 201 bp, Homo sapiens; identical to SEQ ID NO: 243

SEQ ID NO: 2337 - DNA, 201 bp, Homo sapiens
gtctagtgttcttagctgtcacgttggctccttccagggtggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtctt

SEQ ID NO: 2338 - DNA, 201 bp, Homo sapiens
tagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattc

SEQ ID NO: 2339 - DNA, 201 bp, Homo sapiens; identical to SEQ ID NO: 244

SEQ ID NO: 2340 - DNA, 201 bp, Homo sapiens
taacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggc

SEQ ID NO: 2341 - DNA, 201 bp, Homo sapiens
tttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcat

SEQ ID NO: 2342 - DNA, 201 bp, Homo sapiens
agatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgc

SEQ ID NO: 2343 - DNA, 201 bp, Homo sapiens
ttaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccc

SEQ ID NO: 2344 - DNA, 201 bp, Homo sapiens
gtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattg

SEQ ID NO: 2345 - DNA, 201 bp, Homo sapiens
agtggccacagtcatgtcactgggtaaagtgcttattgaaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagatt

SEQ ID NO: 2346 - DNA, 201 bp, Homo sapiens; identical to SEQ ID NO: 251

SEQ ID NO: 2347 - DNA, 201 bp, Homo sapiens
aggagaagccgatgtgtgagaagaccaccatcaacaatgagtacaactaccgctgctggaccacaaaccgctgccagaaaagtaagaatgatgctgactgytgctttctctctgcctctctctctcctctcctcctccttgacctcccttctcttctgagtgcacgagttccgctgggcagggtgcagtcgtgttgcattt

SEQ ID NO: 2348 - DNA, 201 bp, Homo sapiens
tttgcctatccttccacttcacagatgagaagactgagacccagagagggtcatggttttcattagccaaatggtgcagaaacccagtggtcacagtggcyctctagctctttgtcacccacagggcccttgataagagtacggtctttctccaggggagcagggttgaggagtgggggcagccctggcctgggtggccat

SEQ ID NO: 2349 - DNA, 201 bp, Homo sapiens
ggacattccgtctgcggggagccgagtccgaggctggagcaactctggaaccacagccctccagtagagggcacacgagagcaggctatctgtggagatakcctgttggcacaggggtgaagatgacagaggcgaacccaagcaaagagagttaattagcagagtttgccctccaggctcggagggcaagtcagcctgggg

SEQ ID NO: 2350 - DNA, 201 bp, Homo sapiens
atccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgc

SEQ ID NO: 2351 - DNA, 201 bp, Homo sapiens
tccatcagcataattccttatagattcattcaggttgctgtgtttatcaatagtttgtttctttttattgctgaatggtattctgtggtgtaaatgtactrcattccatgagcatggcatgtccctccatttatttagtttttctttgatttacttcattagcattttgtagtttttgtagtcctgtgtatgttttggtag

SEQ ID NO: 2352 - DNA, 201 bp, Homo sapiens
tgagactttgggttttgttttcctttacaccttgagctttgttctacagcaggtccctgggaagactggtccacaaagctgctgaatggggctgctgtccwtcagccctgcctcctgctgcagaatgcagaggacgctgtagacttgcttggtgggtgcctggggttttctgcctccctggtgcactgggcacagcggctt

SEQ ID NO: 2353 - DNA, 201 bp, Homo sapiens
taaacagcagaatattccaggaaaccttaagtgataactgagttgaaagagtcatattttttaagcaatacaatttaaataatttttaaaggaaacatttmtaaaggacgttttacattgcttgcattaaaaagaatataatgaacataatccaactttttctcaatactcagggtcatcactgtgaaagtaacttcattc

SEQ ID NO: 2354 - DNA, 201 bp, Homo sapiens
gagactttgggttttgttttcctttacaccttgagctttgttctacagcaggtccctgggaagactggtccacaaagctgctgaatggggctgctgtcctkcagccctgcctcctgctgcagaatgcagaggacgctgtagacttgcttggtgggtgcctggggttttctgcctccctggtgcactgggcacagcggcttg

SEQ ID NO: 2355 - DNA, 201 bp, Homo sapiens
ggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcc

SEQ ID NO: 2356 - DNA, 201 bp, Homo sapiens
aagtctgtgcttgcattatgtatcaaaacttagtgctatctcctcaggtgcagggttctctggaactctgtctaggttggtctcttggatggcattcttgsagacttgccggaaaaccaaacaaaaggtgtgagtgcatgcctcctggatagatgtctttttagtgtaacttagcacaccttgtacactgtcagggcgcct

SEQ ID NO: 2357 - DNA, 201 bp, Homo sapiens
gcttctatgacttataatattcacttgtagaactcactggcctttgtcagctttcagagtatgtgaacactttttgccatgtaagtagttagtccattggyaatggatatatgtaagttggtatcttcactgcaaacatttagttaattgcgtttattcttgagccattcttgctctacccttaggacttgattttcagta

SEQ ID NO: 2358 - DNA, 201 bp, Homo sapiens
tatcgtataacctggagcaccctcaagctgtccgcccttttcaagttttaaaaatggcttaggcaaacatattgcttaagtgatatccagtgaaggtgtcycctgtgctttgaaaaaccatcaacattgatgcttttttgtgacccaataaggacaagatttcagtggttctgggatgcatttgatctttatgcacacttc

SEQ ID NO: 2359 - DNA, 201 bp, Homo sapiens
gttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataa

SEQ ID NO: 2360 - DNA, 201 bp, Homo sapiens
gtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaa

SEQ ID NO: 2361 - DNA, 201 bp, Homo sapiens
attattacaatttgatttgaaatgtctagagaaagtgagagattatggaaattaccataaatgctccctttttcatagatttagatctgttaattgcaagmaatctttttttaagtgaatcaatgggaactttttatttcttccctaagattcatttagccttgaaaaggccaaaagttgaatgaagcttctaaatgccaa

SEQ ID NO: 2362 - DNA, 201 bp, Homo sapiens
cggtttatgtgaaatgtctagaataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattat

SEQ ID NO: 2363 - DNA, 201 bp, Homo sapiens
tttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtggagaaataaagacag

SEQ ID NO: 2364 - DNA, 201 bp, Homo sapiens
tctgaaattcaaaacagcagggatggccttcgccgacgcaggagtcgggcattttaaaataggctgtttttcttttggagcgttcttcttgaaggatattstttgtgcaagacggcgatttttgagaacacaggcaggagggagggggtgttttaatgtatgtttttactccatgataccaaagcttccccccaggatccc

SEQ ID NO: 2365 - DNA, 201 bp, Homo sapiens
tcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacatga

SEQ ID NO: 2366 - DNA, 201 bp, Homo sapiens
gggctagggttaaaacccgtggagtaatacgccctcctattgtgttcctctcctctaaaaatgaaggtgaaactgtttcaggtgagcgctgttgttgttcrtttgctggggcactgctttctgatttttagaggagtccaggctggagactgacccctgcctttttctgagttgggccggctgggcccgaggctggttctg

SEQ ID NO: 2367 - DNA, 201 bp, Homo sapiens
caaattttgtgagttccctggtaactgactgtatggaagacagaaataaaaatcagaataaacttttattttctgaatcagaaagcagttgctccagcttytggtggtcacattgctaagatgtaaaaaacagaagttaggtgaaataaattaagaataattattttggagaaagagagggtagtgtttgactaaattaga

SEQ ID NO: 2368 - DNA, 201 bp, Homo sapiens
tcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctgtctccgtgagtctg

SEQ ID NO: 2369 - DNA, 201 bp, Homo sapiens
tctttgtttacagggaaaatgctcttgagaaaatggaggtcattaaacactccagcttcagcaatatcatcagagctttccgtcacgtgagttatctcacmaaagggtcagattctggtaaaaactcttgccttcacacttacttctgttttattttgccttatttgacatttcaccagaattgatccataggttcaataa

SEQ ID NO: 2370 - DNA, 201 bp, Homo sapiens
tcaatctctagaacacttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctc

SEQ ID NO: 2371 - DNA, 201 bp, Homo sapiens
gcttaaggaacatcatcctctgttgggcagaattcttccatggccaccccagcattatgccccacaccatttgacttactcatttgtgaatgccaactcaraatgtattgctttgattcttgattaggatctcaacctctatttattgttaagactatcaccctttgattcccccccatcccattgtgtccttctaaaggc

SEQ ID NO: 2372 - DNA, 201 bp, Homo sapiens
gtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactgg

SEQ ID NO: 2373 - DNA, 201 bp, Homo sapiens
aggaaagacgtggggcagcattgtgggaagagcaaccaagattctcataggcttgggagcggaagccctgaggtctgttgctggactagatatgtgaggtktgagaggagagaagaatcaggaatgactctttgattcttaacgtgagcaactcagagaatgagagtgctgcagtttacaagcttggaaggtggattatgt

SEQ ID NO: 2374 - DNA, 201 bp, Homo sapiens
ccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaa

SEQ ID NO: 2375 - DNA, 201 bp, Homo sapiens
atttcatttcaggtgcagatgccttcactttcccacaaaaaaaaccccaacaaaacctaagaccttactgcaactaagtctccaagtactttttaacccawtgggatgaacagcctgtggtctgctcagatcaccctgagtgcgtgtgagaaggcctgggctttgccaggaaatccaggaaggcagggccgggctgtgttg

SEQ ID NO: 2376 - DNA, 201 bp, Homo sapiens
tctcaccgtggccattacgggctgctgtttacaaaaatcctgcaggcctttgacaccccgtcctcccttcccccggcatccctgcccttattctggctttyttctcttccatctcctggtgagcacagcatactgttctcaggcttgttttccttttattgctctccatgtgggacaggtcatgctttatcaacatgtacc

SEQ ID NO: 2377 - DNA, 201 bp, Homo sapiens
ggtgaagttggaagcatcacttagaaacacgcctcctttgggcatatggtgtgaatcagggactctggctataaaaggtggggtctctgagcaccatcctrgttggaatgttcccctgacttggaggtagcgagagacagccaaggtgtttgttccagggaggctggtgggtgggagatgggatttttctgtctgtggcac

SEQ ID NO: 2378 - DNA, 201 bp, Homo sapiens
cttcctgggccctccgtgctcttctgagttctcttctcaaatacctgttttcttgggtcacaggagattaggagattaaagccattctctctggtcctgcrcctcccttgccaggcgtggctaagaggtttgtccttgtggaaggagctgagtgggttggtcgacctgtgcttttccgtgggtaccttaattctaccccat

SEQ ID NO: 2379 - DNA, 201 bp, Homo sapiens
attatttgtttatttagacctcccattatagaaagtgtgacatgctgggcctctggggaagatttttgagggttttgatgtcagagccccgaactttctcygaacttaattgtctttcagaccctttaagaatgtcacagagtatgatgggcaggatgcctgcggctccaacagctggaacatggtggacgtggacctccc

SEQ ID NO: 2380 - DNA, 201 bp, Homo sapiens
tgctgtcctctgcaaagaggaatgcttatccctgttacttattcctggtttcctccaagactagtttcagctggacttcagttgccaaggacttgtcttcygtaatgcccacagaaaataataatgccacattgtaaggtgaaaacagtaatcctggtatttttgtattttagaagaaggttgaagggaaagaaaaggatt

SEQ ID NO: 2381 - DNA, 201 bp, Homo sapiens
aggggagagcacacctgcagtgaggcaattcacatagcaaagttctccggaaactgcagtgttcaacttttttaaagaatagctggatgttagaaaagtgraggaactgtcacctttattaggggcatcatggatacctggtagcatcaagggctagggttaaaacccgtggagtaatacgccctcctattgtgttcctct

SEQ ID NO: 2382 - DNA, 201 bp, Homo sapiens
tgcacatgttaaaaacattctaggatccacacagtttaaacaaggtggctggcttaggaaatgcttctccccattccttggcatccccacaaccctattcycctactttctcttatgtatctggactggcttttaaaagatatttagtgaaatttaattttctagggaaactccactttgtcaaaagtgtagtattcctca

SEQ ID NO: 2383 - DNA, 201 bp, Homo sapiens
ctgatgccgaatccacttggcagcactgagttacaagaaggttaagtagatgaactagaagatggataaacgaagatagataaaatgaagaaaaacaaaartcaaggagaactcaggcgtccaagagtgtgtaaacaacttctggtgtgagacgcgctacattgcgctaaatggcctgtgcgcttctggtttttcccttcc

SEQ ID NO: 2384 - DNA, 201 bp, Homo sapiens
atccagtatgactgctcttccatagatgatgaaaccaaggcagagaaataagatgtaactctcttaccttgattagtgatgagaatgggacagctttattyatgaaacccggaaaccactagcccattcttgggatgattgatatctgcaaggatcttcaggaatagagtacctggggctcaggagccaagactagaagtg

SEQ ID NO: 2385 - DNA, 201 bp, Homo sapiens
aaaacagcctgcgtatgttcttgcttgcaactcagatatccagcccactgatccaggaagagattcctttgacctgggaagtcataatggcagatatttaracccagctctcaagcaagcctccaagttgttccggtgaacccgtaactttgagtaacctctgattgaaccagagagtaggaactaggtgcagaaccttgt

SEQ ID NO: 2386 - DNA, 201 bp, Homo sapiens
ccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattct

SEQ ID NO: 2387 - DNA, 201 bp, Homo sapiens
ctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacagttatgaagcaggggttactaaagtgggagagagca

SEQ ID NO: 2388 - DNA, 201 bp, Homo sapiens
gtgggtcccagaaatgagtttcatggaggggagagcttgtctctctgggtgggtaatacaggggccactgggggctcactgtggctttctggcacagacakttatgaagcaggggttactaaagtgggagagagcagccagttctccagcagccccagtgagagctctcatggatctgcctattgcactggggtaggagcc

SEQ ID NO: 2389 - DNA, 201 bp, Homo sapiens
agtttcatggaggggagagcttgtctctctgggtgggtaatacaggggccactgggggctcactgtggctttctggcacagacagttatgaagcaggggtkactaaagtgggagagagcagccagttctccagcagccccagtgagagctctcatggatctgcctattgcactggggtaggagccatcaccgtcagctttt

SEQ ID NO: 2390 - DNA, 201 bp, Homo sapiens
gaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctac

SEQ ID NO: 2391 - DNA, 201 bp, Homo sapiens
atcagtgacatatgtaaatgttttagggagctgtttactgtaacattacctactttagctctgtgcagttgtctggcaaccaatgtgataaagacagaggraagtgctgtattttgttgctgacaagtatatcttaaaagtgcaggtgcacctgaataggcaataaagtattaagagctgctcctggagcagtttgctctc

SEQ ID NO: 2392 - DNA, 201 bp, Homo sapiens
acatggtggcagcaagagaaaatgtggaagaagcaaaagtggaaaccctgataaacccatcagatctcgtcagacttattcactatcatgagaatagcacrggaaagaccagccctcatgattcaattacctcacctgggtccttcccataacacatgaaaattctgggagacacaattcaagttgagatttgggcgggga

SEQ ID NO: 2393 - DNA, 201 bp, Homo sapiens
gctcctggagcagtttgctctctgtgacgtgtgaaaagtctacggggtttataattggtctggccatacggctgcctaggattagactcttttcatatccyactaaacactctccttagaagcaagcacaaggagatagtttattttaaaatgtaattgctatgttactaagatttgaatttgagtaccgagaataaacca

SEQ ID NO: 2394 - DNA, 201 bp, Homo sapiens
aaaccctgataaacccatcagatctcgtcagacttattcactatcatgagaatagcacaggaaagaccagccctcatgattcaattacctcacctgggtcyttcccataacacatgaaaattctgggagacacaattcaagttgagatttgggcggggacacagccaaatcatatcaccctcttagcaaggactgtgttcg

SEQ ID NO: 2395 - DNA, 201 bp, Homo sapiens
tacttcattccatcctgggagacagagtctcactctgtctccaaaaaaaaaaaaaaaaaagagaagttcgttataacaaatgccatatgcccttttgtacrtgtcaactggacttctataaatttgtcattggtttatgcttttgaaaataagatgttagcattgtttaaaaatgtgataactataactttgaaagcaaaa

SEQ ID NO: 2396 - DNA, 201 bp, Homo sapiens
ctcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaag

SEQ ID NO: 2397 - DNA, 201 bp, Homo sapiens
gaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgt

SEQ ID NO: 2398 - DNA, 201 bp, Homo sapiens
gtgcagttgtctggcaaccaatgtgataaagacagagggaagtgctgtattttgttgctgacaagtatatcttaaaagtgcaggtgcacctgaataggcartaaagtattaagagctgctcctggagcagtttgctctctgtgacgtgtgaaaagtctacggggtttataattggtctggccatacggctgcctaggatta

SEQ ID NO: 2399 - DNA, 201 bp, Homo sapiens
acagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtc

SEQ ID NO: 2400 - DNA, 201 bp, Homo sapiens
tcaatcacgttcacctgttggagcaagtagagtttcagacggtctccgcttttctcgactagaaagcaggccttctcccttttccccccagtcttgtttcmtgacaccattcccctctgagatgagggttggagaattagaagtctactgatgcattgtaccggggcacgttattgaccctctctgctctcctttcctcat

SEQ ID NO: 2401 - DNA, 201 bp, Homo sapiens
tcttctgaattcgttgatatcccttgttgctgttcacaatacacccactcccagccctccgtgatggagataactctgttccccacaactagggcttgccsactctcatggtacttctgatgtttaattcttttggctgtgtctgcatttcctcatttacttttaatttgcttatccctagaacataccttttgagtgcct

SEQ ID NO: 2402 - DNA, 201 bp, Homo sapiens
ctgttcacaatacacccactcccagccctccgtgatggagataactctgttccccacaactagggcttgcccactctcatggtacttctgatgtttaattmttttggctgtgtctgcatttcctcatttacttttaatttgcttatccctagaacataccttttgagtgcctaaacttttttatcttcctgtcctgaagac

SEQ ID NO: 2403 - DNA, 201 bp, Homo sapiens
ccctccgtgatggagataactctgttccccacaactagggcttgcccactctcatggtacttctgatgtttaattcttttggctgtgtctgcatttcctcrtttacttttaatttgcttatccctagaacataccttttgagtgcctaaacttttttatcttcctgtcctgaagacaaaaatttaatctgtgaattaaacc

SEQ ID NO: 2404 - DNA, 201 bp, Homo sapiens
ggtggggctgagggcagccagtgtgactgaggctcgctggcccaccctgagctgcttgtgcccatggggcccctggggaggagggcccagctgcagtgcgsatacatctgcccttggcagcagatctgtgaacccaggctgccattctggatttccggatagatgcaaagtgcttggacgtgttttagcagctgctgagac

SEQ ID NO: 2405 - DNA, 201 bp, Homo sapiens
aacttaaaaaagcaacaactaacttatttgtatcttttcctctaatatttagtttttacttcacttgtaacttattacatgtattaaggagtttatttttwtatgacattttactcataaaaggatgaaaccaagattggtgatctgttcacatagattaaaatcctgtttgtgaccacttaggtgtgtaatgtgtgactt

SEQ ID NO: 2406 - DNA, 201 bp, Homo sapiens
caccctcaaacagttacccagtgagtctcctcaaagcaagtggcactgagatacaaccttcctacaggttttcaagtcatctcgtgtggtgcacagtcctsgccctacctcgaaggcccgggcgaagttttcctgagtgtgtatactcatctctttgtgttgtctctggcagggagcaagtgagtacaggattggagtaat

SEQ ID NO: 2407 - DNA, 201 bp, Homo sapiens
agaatttaaaataaaatacattttgacccattgtattgagagctggtataatttaatatagtgagcccctcggcttctggttggttgggttataaagcttsttattcattcgctcatccattaatgcatttctcctatgaggaagctttttcctttgagctgaacacacaaaattaatcgtgctcgaactctccaaatttt

SEQ ID NO: 2408 - DNA, 201 bp, Homo sapiens
ttttgagaatgtgttttccttaatatttgttaaatgagtagactgtattcttaaggtttagaaaggacagaaacaagtttgtgcttagttcttctgaattmgttgatatcccttgttgctgttcacaatacacccactcccagccctccgtgatggagataactctgttccccacaactagggcttgcccactctcatggt

SEQ ID NO: 2409 - DNA, 201 bp, Homo sapiens
gccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgccatgtgcttctggcaggcctggataaggtttgccctgcataacccttggaaagcaca

SEQ ID NO: 2410 - DNA, 201 bp, Homo sapiens
gaagagccctaacagtaggtcctggctggggtctggcatagaatgcccttggcacgatgtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgta

SEQ ID NO: 2411 - DNA, 201 bp, Homo sapiens
caagatttcagtggttctgggatgcatttgatctttatgcacacttcagctctgggtttcagttcaggggtcagcataagtaaagcttgatcagataactrtgctttgcctataatcggcattcattctgctggtgacagagtcctttgctcaaaatgaggcttccatgcgtttgcagttctaaactgcttttcagagtca

SEQ ID NO: 2412 - DNA, 201 bp, Homo sapiens
gcttagttagacatggaggatgcatcttaacaagttagtacctttttgcaaagcatgaagactaattcaaagtctattttctggttttgctctaccagtayggccaaaaccatttctttttaagtgagaagtggggatatggtcaggtttgattccagttgaagttgtgagctgcacagggctggtctgagcccagtggca

SEQ ID NO: 2413 - DNA, 201 bp, Homo sapiens
ccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataac

SEQ ID NO: 2414 - DNA, 201 bp, Homo sapiens
gaaaataaaccccacataactagtgctgctattgatcattcatatagccagcaggagtggtgagaggcttggtctgcctgaggtgtggagatgcttgtggyggggggcaaggtggacgagggctggggctgctcctggagcatctttacgcgggtggaggagctctgacacagtggcagtgtttgtaacactttccaaagg

SEQ ID NO: 2415 - DNA, 201 bp, Homo sapiens
gaacgaccatatccgtggggccaagagtgagatcttgtacattcgcaccaatgcttcaggtatccatgcctagacaagcccccagcatccacacttcttcrcaagctcactggccttgcttgtaccaggtgtcattgtagggttagcagtgagctatgcctgttgtctttcttgtcaataggtaatactgtgtcatattca

SEQ ID NO: 2416 - DNA, 201 bp, Homo sapiens
cacagcccggattcaggccacatctctctctgggaatgggtcgtggacagatcctgtgttcttctatgtccaggccaaaagtaaggcttgtggagggagamgaaacgtggtaaaactgaaagcagggtggtccaggatcaggacagcccgagtgttcatggctgtcttattttctgttaaaatggagttggccagcttcca

SEQ ID NO: 2417 - DNA, 201 bp, Homo sapiens
gtagaaacacacacgagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagcca

SEQ ID NO: 2418 - DNA, 201 bp, Homo sapiens
tcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccagg

SEQ ID NO: 2419 - DNA, 201 bp, Homo sapiens
tagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgg

SEQ ID NO: 2420 - DNA, 201 bp, Homo sapiens
aaatttctctttgtccctgcagggactgttgcagagcattagagccaccctcaaacagttacccagtgagtctcctcaaagcaagtggcactgagatacarccttcctacaggttttcaagtcatctcgtgtggtgcacagtcctcgccctacctcgaaggcccgggcgaagttttcctgagtgtgtatactcatctcttt

SEQ ID NO: 2421 - DNA, 201 bp, Homo sapiens
ttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctactt

SEQ ID NO: 2422 - DNA, 201 bp, Homo sapiens
tttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtcccc

SEQ ID NO: 2423 - DNA, 201 bp, Homo sapiens
cgatctcaaaagttatctccggtctctgaggccagaaatggaggtcagttttcatttccaccggtattgcatgttgcctggcctgctctcttttcctttayaatctccctgcaaggaaatgctgtgtctttaaatcagtttactttccagcatccagtgtttcttactgcatgctcagttgtaggtcatttatgcaaagga

SEQ ID NO: 2424 - DNA, 201 bp, Homo sapiens
ttcttctcaagggctcaagatgttttcccaatgcccagcgtctcatggatgacaaatatgacaagtaattttaccagaggcagtttgagggctcttagcayagcacaagtaaattatgttggttcaagtccaaggaactttgttctctttgtgtttgcttttgtagccttacctctttggggcatgagttagagacataca

SEQ ID NO: 2425 - DNA, 201 bp, Homo sapiens
agtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagccgtg

SEQ ID NO: 2426 - DNA, 201 bp, Homo sapiens
tgctggttgagcttctgctaagaggtttccttccagggactccatgttcactgcctcacaaaggcaggccagcctcatgctttagacatccttgctcttarcaaatctttcgtgttctgctacgtcagcctctgtgtgacacccattggaccttctctctgtagcacaattgcataccttgctctgttcttgataagatag

SEQ ID NO: 2427 - DNA, 201 bp, Homo sapiens
gtgtagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttc

SEQ ID NO: 2428 - DNA, 201 bp, Homo sapiens
caaactaacggtaggactttcctcagggatttaacgtttgctgtagaagactgaatgatagaatatataagctgtatttttcttgtgattctacacattgyccatgttgcaacttaaatatttttggaatgcaatgtaaaagtgatttactgtcctataattgttttcctgaaagcaaaatgatatttaagtgaactgcaa

SEQ ID NO: 2429 - DNA, 201 bp, Homo sapiens
ggttaggtgataccgccttgccagataaatggccgggactaggtagatgctgaacccagtatgctctgcgttcaaagcacagatcaggggcttcctgaccrtgcaagggatgccggaagcgccctcaccaccttccttagctccaccaccggggctgaatttagtttacggggaacattagcagcaacagagggaggatga

SEQ ID NO: 2430 - DNA, 201 bp, Homo sapiens
tttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctcctgcctgtaatcccagcacttt

SEQ ID NO: 2431 - DNA, 201 bp, Homo sapiens
tataaatctagacttcctttggaatttgtttcctttttctcagccaggtgtatgaagattttaagttcttaggcctcagtgggaagaagatttaaggttcyaagagtacatttgtatctcttttaaattttctattgtttatcagtgacatatgtaaatgttttagggagctgtttactgtaacattacctactttagctc

SEQ ID NO: 2432 - DNA, 201 bp, Homo sapiens
gtcctgctgtctggggagtcgttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaat

SEQ ID NO: 2433 - DNA, 201 bp, Homo sapiens
caccctctggtccagcgtgcctgttacagtgatcactccatagtggttttgcatgaacaagactgcccagtttgcttaggaagaaaacaaaggacataagktagttctcatgtcttcccagcaccctaaatactcgggctaaacttccacagtcagaccgtcagcttcaggaagggctgctgttgggaactttttttttag

SEQ ID NO: 2434 - DNA, 201 bp, Homo sapiens
aggagcttggaggtcagcttgtagtataataaaatagaaaactatacagccggggagaacagaagcagaatagaaggataaagtgttgttcatatctctcrggcaaattttacccaaattctgacgagcagttactgcacaagcaacaacaaagggacctagagtgtgttcattgccaattctgtccatttggctacataa

SEQ ID NO: 2435 - DNA, 201 bp, Homo sapiens
tctgacattacttagaagtatgtctgtccttgaatttttcttttgcttaccttttgatattgtttatatgatttatgaatgcagctctgaggtatctgagrggatttattaacgtttacttgcgtccaagtacatgattaagttttaattgctttgtggacattaaaaaattatgcccttggtaaaatgcaaaggttttat

SEQ ID NO: 2436 - DNA, 201 bp, Homo sapiens
gagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgtttttgtagagatggagtgttgccatgttggccaggct

SEQ ID NO: 2437 - DNA, 201 bp, Homo sapiens
ggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaagg

SEQ ID NO: 2438 - DNA, 201 bp, Homo sapiens; identical to SEQ ID NO: 263

SEQ ID NO: 2439 - DNA, 201 bp, Homo sapiens
ggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggtgt

SEQ ID NO: 2440 - DNA, 201 bp, Homo sapiens
gaacttaaatattaacgtgtatataagttaatagtaagtagaccgtgaatttagaagagtaaaacagaatcatgagtacgtagtcactgtggccccttttytgctggatttcaagttcgtaagcatttttggaagagagtcgaaggggaaggggtggcttgccagtcagttgagtgatgcgtgagggaggcgttaaatgtg

SEQ ID NO: 2441 - DNA, 201 bp, Homo sapiens
ttagaatttaaaataaaatacattttgacccattgtattgagagctggtataatttaatatagtgagcccctcggcttctggttggttgggttataaagcytcttattcattcgctcatccattaatgcatttctcctatgaggaagctttttcctttgagctgaacacacaaaattaatcgtgctcgaactctccaaatt

SEQ ID NO: 2442 - DNA, 201 bp, Homo sapiens
accccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggttt

SEQ ID NO: 2443 - DNA, 201 bp, Homo sapiens
ttgacccattgtattgagagctggtataatttaatatagtgagcccctcggcttctggttggttgggttataaagcttcttattcattcgctcatccattmatgcatttctcctatgaggaagctttttcctttgagctgaacacacaaaattaatcgtgctcgaactctccaaattttgtgagttccctggtaactgact

SEQ ID NO: 2444 - DNA, 201 bp, Homo sapiens
tttctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaa

SEQ ID NO: 2445 - DNA, 201 bp, Homo sapiens
gcataaagctggaatgatggacatgatttctttaatcactccaaattagtcatttagttgtttccagttttttagtattacaaataactctgcaataaacrtgtcttgggtatgcattcttttagtttaaaatagtcttgttccttcagaaagttgctcaataatagacttagaaattcttttgtgctaattactgtaatt

SEQ ID NO: 2446 - DNA, 201 bp, Homo sapiens
acctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttc

SEQ ID NO: 2447 - DNA, 201 bp, Homo sapiens
ctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgt

SEQ ID NO: 2448 - DNA, 201 bp, Homo sapiens
taaatgtagggaaggtgaagtgttcaccttcagatggtagctatttatctcagcaagaagagcagatgactaacacccaaatacataaccattattatatracttagcatttataaggcatttctatgcatcctgagagactagagcactctcaaatgaggtttcagagtaagattcatctttgcaaatgaagacaaatta

SEQ ID NO: 2449 - DNA, 201 bp, Homo sapiens
tgtttctcccaccccaacatgaaaaagatggagtgagcctgcagccctgagttgatattgctttttaaattgagaacaatataattacagccttgtactgkttataaaactttaaggtctcatatcagagatacagcagtgcctttctcatctaaccctgtgtagaatacggctgttgagaatggcgtggctctctggctg

SEQ ID NO: 2450 - DNA, 201 bp, Homo sapiens
ggtccacttaatggaagagtctaagagtggcttcaggaagtccactgggggctccccgtgactctgcccacctgcatattgtcttcattctaaggatccakgtggtagcaaaagggttgttacaactttaaccctgcatccccaccttcaggttcagtacccaagggtgagcaatctgttccagtggcacagacctgtttc

SEQ ID NO: 2451 - DNA, 201 bp, Homo sapiens
caactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattg

SEQ ID NO: 2452 - DNA, 201 bp, Homo sapiens
tcttttcacctttggcttttaataagggaagggtattagaaaaaaagtaatttgtatgatgaagggtgatttgtgcgtgtgtgcagacagacacacatgcrgggaggcaaatcagaaccgatgcgtgtttggctttggcttgtttcgctggtgtctggatttacctggcgacacttgttgctctgggggatcttagaggga

SEQ ID NO: 2453 - DNA, 201 bp, Homo sapiens
ccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgctttttccagaattaggtcagtccagactcatgaacgatgatgggggacttcactgaaatatc

SEQ ID NO: 2454 - DNA, 201 bp, Homo sapiens
agtaatttgaaacacccgtgtaaactacctttggcaaataggatagctaaatcaccgctaagatttataatttactttttggatatctgaaacatcaacartatagccatccatggcgtgttcctctggagtgtggtccgtgccgtctctgcctgctccatctggctgatcccaggcaggcagctcagctctcagcagaca

SEQ ID NO: 2455 - DNA, 201 bp, Homo sapiens
atgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccgttgtacat

SEQ ID NO: 2456 - DNA, 201 bp, Homo sapiens
tgacagccatgattgggaaagtgttagctcgaggcctgtcattctttagtgagtgattagagatgtttgaataaaataaacccaaaatggggaaagcttgytttttccagaattaggtcagtccagactcatgaacgatgatgggggacttcactgaaatatcgtttcagcctccttacctactaggcctactccaggaac

SEQ ID NO: 2457 - DNA, 201 bp, Homo sapiens
ttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgct

SEQ ID NO: 2458 - DNA, 201 bp, Homo sapiens
caactacttaggatttttgttgttgttgttgttttcctgtacattgtcttcctatctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctg

SEQ ID NO: 2459 - DNA, 201 bp, Homo sapiens
ttgctccctgttcagatcatagtaaaatcggatgtatccgagtatttcagagtgcttgtctccttagagtcagccagtctgacctgtcagatcataatacrtagtagccgtttattttcttttgaaagcaaaatcatggtttcctctctaaataacacttcagcaggaactgtgacatttcccaatctcagttgcgcacat

SEQ ID NO: 2460 - DNA, 201 bp, Homo sapiens
agtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttacc

SEQ ID NO: 2461 - DNA, 201 bp, Homo sapiens
acaaggcattttaccaagtccggctgaaagagcttcttaccacatctggcatgtagaatggcagaagactatttttgctagattccttgttgctgcagccrtttctgatgtccttttccccttcacacctttcgtgttacacatgtctgagatgacatgatgctaagtaaccaaagtactgctgcgatggaattgctctga

SEQ ID NO: 2462 - DNA, 201 bp, Homo sapiens
aaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttt

SEQ ID NO: 2463 - DNA, 201 bp, Homo sapiens
tgttttggtgaaacctgataaccttgcttttctccgtgtaccttgtttttcattgtaaaactatttaattatgaaaatgagagtgtgaaaggcaaagtatrattgaatttagggggcagttccatatagttgtaacaaactgattatcaaatgtccaccattagtatgttaaaatacggttttctaatactgagacaacag

SEQ ID NO: 2464 - DNA, 201 bp, Homo sapiens
gtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaatcagatcaagttctctctctcctg

SEQ ID NO: 2465 - DNA, 201 bp, Homo sapiens
tcattttgggttgaggtatcccctggtaccctctcctgaacttcaatagaataacatgatgtggtgaatgaaccatattagaaaaaccagccaatcagccragattcttgtattgactcttctgatctccctctacctctcctttccccatctgccaaacaaagggtttggaacagttaaattctaaagtggtgtcattga

SEQ ID NO: 2466 - DNA, 201 bp, Homo sapiens
tggcacagagatttgctgtctggctagcagtacttcagggtactgggtggcttgaggacctcctgttagaagcttggattcacttttcccaaggcaaccasgattggattctattagttctgggtcttgagagcctgcaagggcttccttctgcgaaggtgagtctgggagagacgccatggagtcagtgtgagttctgca

SEQ ID NO: 2467 - DNA, 201 bp, Homo sapiens
gtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctgt

SEQ ID NO: 2468 - DNA, 201 bp, Homo sapiens
tttcttatactcagtcatttgtgaatgatgtggttcaaacaaaactgaaacaaaaatagtttttctcattaaaaatatgtttgtcgcatagccagcactcrgaactagggagggtaacatggaagtattgtcattctcggggctgactggttgacagcagcctatacaggagtggagaatattgacagggctgcccgttct

SEQ ID NO: 2469 - DNA, 201 bp, Homo sapiens
aggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagc

SEQ ID NO: 2470 - DNA, 201 bp, Homo sapiens
agaatgggagttggaaagaaatgttttctcccacacctgtcccgctcctgtctactgaaagctgattaatcagtcagatagtgagttcctattggtagtamgcctccaaaatttggaagaggggaggtggcgtgatgtgaaaaagcaaggctttagggagagattcccgctgggggcattcaccctctggtccagcgtgcc

SEQ ID NO: 2471 - DNA, 201 bp, Homo sapiens
ttactagttacgtagctcaggaacctggaaccagactccttctccagctgggcagtcccaggtttgagtcctggctccactggaggttgtctgacttggakgttaataataacctgccttagtcccagagtccttagagggaaaataggttataatacctgagtccatgtgtatcaagccattgctggttccaggcccctg

SEQ ID NO: 2472 - DNA, 201 bp, Homo sapiens
gatgttcagaaccttgtgtgtatcgtataacctggagcaccctcaagctgtccgcccttttcaagttttaaaaatggcttaggcaaacatattgcttaagygatatccagtgaaggtgtctcctgtgctttgaaaaaccatcaacattgatgcttttttgtgacccaataaggacaagatttcagtggttctgggatgcat

SEQ ID NO: 2473 - DNA, 201 bp, Homo sapiens
gcaggagtcgggcattttaaaataggctgtttttcttttggagcgttcttcttgaaggatattctttgtgcaagacggcgatttttgagaacacaggcagragggagggggtgttttaatgtatgtttttactccatgataccaaagcttccccccaggatccctttacagtggttagttcctggaaacctgatgggtggt

SEQ ID NO: 2474 - DNA, 201 bp, Homo sapiens
ctctcttaagaagtttcagggcagcctaaaggctcaccttcaccctaccaggccccctttcatagccaggatcttagggatggagaagaaagataagttcrcctcgttcactgaagtcgccccttgttttcaggttaggaaacccaggttcatgtccaagtccctgggcaagtagccagcgtaactgattgacctaaaaca

SEQ ID NO: 2475 - DNA, 201 bp, Homo sapiens
agaaatcactgggctacagttttggattaaggttactctactgtgtcagtgcgagctgtcctgagagaattagggtcttcctaagtgatgcagacaggcgyactgcaactccatggcagagctgttaacacctagtgtgtcttttacagttagagttttaagataattttacaggactttaataaatttaaagctccaaaa

SEQ ID NO: 2476 - DNA, 201 bp, Homo sapiens
cctgtggatggagactttgttccataagttccctatagataagatgtaatgaataattcattggcaccgatttatgtctgtagtgtgcttttaaaccctcytggagctgggttcctgaggaggaagcatctgcaggctggactcggctgcctggtggtctccggagtggcctggtgcagagggccagggtggcatctcaga

SEQ ID NO: 2477 - DNA, 201 bp, Homo sapiens
ttttgcattgttttcttggtgaggccagtaagcttttgcctcactcctgggagggacagtagcaaggtcttacaggtctctctatcattgaagcaccctcyccaaccctgccggttttggttgctggtgaaggcctttgacagtgtcctggtagggcgacggtgaggccagctcccgacctctggacagaagaaagcttac

SEQ ID NO: 2478 - DNA, 201 bp, Homo sapiens
atgcatctttgcaggaacttgcccctttccactgaggtttgaggcagactccaaccacatttccatccagtggcttagtggtcttacccgtgagcttgaastgttgtccctgccaggacagtctttgcctctgtaagtatctccatattcctccatcctttcaggtcccattcagtccctaggtcctccatgatggaatat

SEQ ID NO: 2479 - DNA, 201 bp, Homo sapiens
caagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtct

SEQ ID NO: 2480 - DNA, 201 bp, Homo sapiens
cctacttccaaatgagtgggttgtccaggtgtgcttgtagatgtcacatacttctaacaaggctctgcagctgcgatgtcaccttgcccagcgtgacctcmttagcatgtatgtggctttcagtggccatgtactttgcttctagagctttctttcccattctgggttcttaggagggggctgtgctttgtgtgtggccag

SEQ ID NO: 2481 - DNA, 201 bp, Homo sapiens
gagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaa

SEQ ID NO: 2482 - DNA, 201 bp, Homo sapiens
acccagaaaatatttcttattgttgataatctgcagtttgcaagtgcagcgaatcttgtaggtagatttaccttgagttttttgaaacggtagaattaatrtattaaaacatatggtttttagttaaaataggatgttaaaggaatagagcgcacgaacaaagaactttccacttgaacccatgttgtttcatctgacagt

SEQ ID NO: 2483 - DNA, 201 bp, Homo sapiens
ttagccctagctgtttgtcttgcttatttaaacttgtacatggcacatgctcaaagatttttccaggcaaaatttctttaaagcaggatttgagattttcyatccccttccgtctgctggattattccggtgagtgttaatctcccgcctttgtcttagcctctctgtggtcttcggttgcttccttgttctctgtagatc

SEQ ID NO: 2484 - DNA, 201 bp, Homo sapiens
gtaaaatgaagcctctgcatccttcagtaacttacttaaaattttgttagggctgcattttcttcaaagccaagttctgaataagaagtatttgttttggrctctagccagattactgaagtattgttgagggagatttgctgtggaaggtgttgggggtacagggattgtgaagataatgtaaaatatttaacattttaa

SEQ ID NO: 2485 - DNA, 201 bp, Homo sapiens
ttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaa

SEQ ID NO: 2486 - DNA, 201 bp, Homo sapiens
tagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacatta

SEQ ID NO: 2487 - DNA, 201 bp, Homo sapiens
ctaatacagtcagcccagccaagatagtgccatcctccgcaagcatccactaaggcatggagtcagcttccgtcattgttagatcagtacttgtttctttsccttgcttatttttcctaacctctctgaacctgctgtgttggaagcttaaggaacatcatcctctgttgggcagaattcttccatggccaccccagcatt

SEQ ID NO: 2488 - DNA, 201 bp, Homo sapiens
tgctgggattataggcgtgagccactgcacctggcttatttaaatttttatgggtatgaattcacttaaaagctgaaggttttgagaggagagggagcatrtgaaaaaacctaaaggttttgggaggaggaggagaaggaagagagggagcatgtgaacaagagcaactgattacttccttgtcattcatttgcccagtgt

SEQ ID NO: 2489 - DNA, 201 bp, Homo sapiens
cccaaagtgctgggattataggcgtgagccactgcacctggcttatttaaatttttatgggtatgaattcacttaaaagctgaaggttttgagaggagagrgagcatatgaaaaaacctaaaggttttgggaggaggaggagaaggaagagagggagcatgtgaacaagagcaactgattacttccttgtcattcatttgc

SEQ ID NO: 2490 - DNA, 201 bp, Homo sapiens
ccaccatgtcactctgacttccagatgataatgagtgtgaccatgggctgaatgaatgtctctctgctgggattaaaagttagaggaaggcaaaaacagayattgcgtgttctcacgtatacgtgggagcaaaaaaagttgatctcttggaggtagagagtagagtgatggttaccagagactgggaaagggggcgatgaa

SEQ ID NO: 2491 - DNA, 201 bp, Homo sapiens
ttcactcccatgacccaatcacctcccaaaggccatgcctcctaattccatccccttaggggttaggattttgacatgtgagttttggtaggggacacagrcattcactctatagcactgataaacattctttgataatagccattattttagtgggtaaggtgtttttaaatacccataagcgagcacaaaatcagttta

SEQ ID NO: 2492 - DNA, 201 bp, Homo sapiens
acggttaagtttggattgtttgcttattggtttggttattggcaattgctacaaagtccagggtgttctttatcagcagcatgcttatcaagttactgacrttcaagctgagtttccttccctccctccttccttcttctccactgacattttttttttttaaataggtagggaggcatttaatcttgtagcagcatgaga

SEQ ID NO: 2493 - DNA, 201 bp, Homo sapiens
tggtggacttccgtgttctttgcattgcctctcccccatccctcttacacacagctgtgacatgggcatgcacactccttcacacacacagactctccagscccctttccacttcctctttccatttggcttcatgacatttttatcagagattcaaaatctcagatgaaatccaagtcagcctgttttaccagttgtcga

SEQ ID NO: 2494 - DNA, 201 bp, Homo sapiens
ccattagagctacccatagctggtgaagactctgcttatagtggaacctagtttctcagttttccatttatatttatttacctgagctttttgtaaagtartaagtacttgactgaatttctgctatttatcaaatgctttttgaatagaaataatgagttaataacatttagccttttttggtaaatagtataaacaaga

SEQ ID NO: 2495 - DNA, 201 bp, Homo sapiens
gaccccagccgaaggcctcagccctgttttctcaccattcgtccatggctgacctgagggttgccctttctccatctgggtgctcctctcgtattctgttygtttttgttggttcctgtaaacattagaattctgttttaaggtttctagggggagccacaaagcccatttcttcatatttgaccaaagcagcaattagag

SEQ ID NO: 2496 - DNA, 201 bp, Homo sapiens
cctgagctttttgtaaagtagtaagtacttgactgaatttctgctatttatcaaatgctttttgaatagaaataatgagttaataacatttagcctttttyggtaaatagtataaacaagatagggcaaatatgtaaactacttagaactttatctaccttgcatattttgtacctcttatttgcatatgcatgtcacatg

SEQ ID NO: 2497 - DNA, 201 bp, Homo sapiens
ggctgcattttcttcaaagccaagttctgaataagaagtatttgttttgggctctagccagattactgaagtattgttgagggagatttgctgtggaaggkgttgggggtacagggattgtgaagataatgtaaaatatttaacattttaaaaattttcagtaagttctctttccccaatgtcagcatgacttcttcattc

SEQ ID NO: 2498 - DNA, 201 bp, Homo sapiens
attccttacctctctcacccacttgaggattgctcagagcctgggtttcggattgaaatagcactatttctggttgatgacgacattctgtgagccagcartgtagtttaaatatccacaagagcgccctggttccatcagcgccccttcgtaattggtcatgagacttggacctccttcggggctgggactcgggcaagg

SEQ ID NO: 2499 - DNA, 201 bp, Homo sapiens
tgtatgcatcttctgcaattaggaatctgctcaccagcacgagtgctgtggtttctgtagttctgggattcagaggagcattttaaagatgtaggatgttrgaggaggaggtgcagggatctccccttgggtaaagagtgggagacagtctctgagtcataatctgggaccagtggaaggtcaaagggaagaactgtcctg

SEQ ID NO: 2500 - DNA, 201 bp, Homo sapiens
aaattacttaacctctctatgcctcaatgttctcatctctaaagtatggaaaataattgcatctgtgtgaaaactgagttactatacgtaaagtttttagratagtacctgacatacagtaagtgctgaataagtatcagctagagagagagagagttagtttccagcagcctgtttctgtttggggtcacatgtggtctc

SEQ ID NO: 2501 - DNA, 201 bp, Homo sapiens
gttctctgtgtgtaagtagttatattattcctaggttatggcatcttgatttatctttgaaagaagaaaaccctcactgagttgacagggacacattgttytaggcttctacaattgtgctgatgacgctttttcccattggaatgacagggatgataaggtcggctggctagcctttttttaaaatgtagaaaaccacaa

SEQ ID NO: 2502 - DNA, 201 bp, Homo sapiens
ccaccctcaaacaatgatttccccaaattggacagcctgggtttgtatccttgagcacagttttgggaagagcattctgcatgaggcattgtagctatgtrtatggagtataattctgttttcaggttgctctgccacagaggttaagaactccctcttccaaggtagacattgagaacagagacgaccacactgggtttt

SEQ ID NO: 2503 - DNA, 201 bp, Homo sapiens
tcttcagcagctgtgagtttacaagatgtcgcacattgagtatttttctctagcttatttagaaacgccagtctagacttccgcagttttggattcgtggscatagttttggcctttattagatggccctcaaaggtacttttcaggtggacattgatttcatgccagctgtcagagatgattttccctagaaatggctgg

SEQ ID NO: 2504 - DNA, 201 bp, Homo sapiens
aactatctcaaggtaattacccttttgaatacttgaggacatcttttctgtgccctctgaatatttccttccccagataaaatatttctagttcttttacytgttctttgtttcagagttttaagtctccatttgataaagtatagtttaatagccttcgaaaccacatcgttgagatttaaaaagccctccttgagagac

SEQ ID NO: 2505 - DNA, 201 bp, Homo sapiens
tggctgggtatatggagacattctgtattagaatggaggtatacacccatctcttctgtattagagagcaggtgttgccccccgtggtgctcagattgctkagtgtgagaaggaaaagaccagtgataagaggaggaaaactgcgccttccatgtagctcagttaacagcatcatgattctccaggatggccccatttctg

SEQ ID NO: 2506 - DNA, 201 bp, Homo sapiens
ttacccttttgaatacttgaggacatcttttctgtgccctctgaatatttccttccccagataaaatatttctagttcttttacttgttctttgtttcagrgttttaagtctccatttgataaagtatagtttaatagccttcgaaaccacatcgttgagatttaaaaagccctccttgagagacatgaccagtagaaatc

SEQ ID NO: 2507 - DNA, 201 bp, Homo sapiens
gcacacaggatgcacgtgggatgtccagtgaggaggatgagatgaggttgggtggctggagcctggtgagtgacaggcagagagggctattagatcacatkggccctggagccatggtgaagaatttggattttgttctctgtgttggaaagttagcagagagcttatatggggggtgagatggcatagggacaatgttaa

SEQ ID NO: 2508 - DNA, 201 bp, Homo sapiens
ggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgccc

SEQ ID NO: 2509 - DNA, 201 bp, Homo sapiens
tcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccag

SEQ ID NO: 2510 - DNA, 201 bp, Homo sapiens
cagagagcttattagtgtcttggccatttggaattccatttcacttaaattagaagagtgaaagagaaatgaatggaagaccaaaaatggggagaagaaaytgtatctgatataagcgtggctctacctgggagaatggccattccgaattactggaaacaggaagaagacttgctatgatgcttccttatatctgtgggg

SEQ ID NO: 2511 - DNA, 201 bp, Homo sapiens
acaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaac

SEQ ID NO: 2512 - DNA, 201 bp, Homo sapiens
cttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaa

SEQ ID NO: 2513 - DNA, 201 bp, Homo sapiens
gaccgcttaggaagctgctgggaccgtgcatatgagagatgttggtggcttgaaccagtgctgggtttctcagcattggcagtattgacgttttgggtgarataattagttggggagtggcagggcggggggtaggggtgcagtcctgaaccagtgccaggtttctcagcattggcactgttggcattttgggtgagataa

SEQ ID NO: 2514 - DNA, 201 bp, Homo sapiens
gaaataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctag

SEQ ID NO: 2515 - DNA, 201 bp, Homo sapiens
aggctgatctaatcagggtattaaccttgccccactcatcttgatttattcctagatcccagttcccagagcatccctttagagcctcagaaatggaacamaagacagctgaaataagcccgtggccaaaaggcactctgagcatgagggaagtaagcaggcttccctgtcactgctgaggctctgtcatccagccccagc

SEQ ID NO: 2516 - DNA, 201 bp, Homo sapiens
ccctgcctttttctgagttgggccggctgggcccgaggctggttctgggctgggccaggctgatgcagtggccttgggcttcccgaggctgggagagggcrgtggcccccgctaccctgaagagctggccaacgcggcagggctctttccagtccttaccatgcaagtgaagaggaacagtttgtttaaagaggggtgcca

SEQ ID NO: 2517 - DNA, 201 bp, Homo sapiens
tgtgactcagcagatgggaattcctttaataacacgctgggtgttagcgttagaaccgccactgaacagctctgcaggatgccctcccagccctccctccrcctatttggattagaccaggagactgcagcaaacttctcaaggggaggcgaacttggtgttggtatctgagcgattgtctgtttcaattgtttccctctg

SEQ ID NO: 2518 - DNA, 201 bp, Homo sapiens
ccttggcctcccaaagtgctgggattacaggcatgagccgccactcccggccgctgcagagaatttttaaaataaatgatagattctcacagataagaagwacaggataattatttgccaaagtttgaaactgccattatattcaaaggcattctcttttgggagtggttttatatttaaggtttgaatttagatgacctc

SEQ ID NO: 2519 - DNA, 201 bp, Homo sapiens
tgacacttgcagagtagagaaagcaagataatgaggaaggacatccctgtgttattcatgagttcttacctaagggggctcaatagctccttctattccayggttaagattcttctgttactcttactcaagtcatagaaaagacaaaagaggtaaaagtacttaaaagccacatttctctcctccttgcagacctgaaag

SEQ ID NO: 2520 - DNA, 201 bp, Homo sapiens
gggaggtggggcccagggtgtccagctttgtagaaaggcatggtgtgggggtggctggcggagggggtggtgggtggttttcctcttgaatctctgagaamcttgactggtgtactgctctctgctttcctaaggggtccgtagctgtgctggtggtttgcttggtatctgtattacatccactctgtgcttcagcctgtt

SEQ ID NO: 2521 - DNA, 201 bp, Homo sapiens
aagtggcttctccgatagtgctggtgaattggaagcttctcgtcatcccccttggctggggcgaggcttacttcctggggccttggcagttttgatctaaytgacttatgttacctttctgtattaatcaagcctttttattttccatacttctgatgctttgacatcttggggccttgctgaccctgaagagaccagccc

SEQ ID NO: 2522 - DNA, 201 bp, Homo sapiens
ggaggttaccaggggctgagggtgagggagcagatttggggagatgttagtcaaaggatacaaaatttcagttagataggaggaataagttcaatagatayattgtacatgatgacagtaataatgatgtattcttaaaaattgctgagacaatagattttaagtgttctcaccacacacaaaaaaatgtgatgtaataca

SEQ ID NO: 2523 - DNA, 201 bp, Homo sapiens
aaaagcagggagaccgcttaggaagctgctgggaccgtgcatatgagagatgttggtggcttgaaccagtgctgggtttctcagcattggcagtattgacrttttgggtgaaataattagttggggagtggcagggcggggggtaggggtgcagtcctgaaccagtgccaggtttctcagcattggcactgttggcatttt

SEQ ID NO: 2524 - DNA, 201 bp, Homo sapiens
gccagctttccgttggtaatgatcacctctgagtgtttttaggaattgcaaaatgctggagcctgcatccattttgagagctacaatatcaataaaaatayttctttcttcgattaaaatacttctaattttaaaaattaaaatagctgtagtagtctttaaagagtaaccatgatcacagttttccatggcaaaataatc

SEQ ID NO: 2525 - DNA, 201 bp, Homo sapiens
tgccagaaataacatacaaatttatcatcatacaactgtacaatatgcaaataacttgctagatgatattactgaagattctacatccaattaaaataaaragagaaaacaccttaagataaccatactattaaaagatacagaagacaactggaataaatggaaagacataccacatttattagacaggaataatcatca

SEQ ID NO: 2526 - DNA, 201 bp, Homo sapiens
tgggagagtgaaagatacctctgagacattttggcttggacagaacagggggtggaggcttccattcctgagctgcaaaggagtggggagggaggagcagygtagtttgggaagtgtgtggtggagaaggcagatggggcaggagctctgtcttgcatctctcaggtcagaaatgcctcagacatccagggggggcaagct

SEQ ID NO: 2527 - DNA, 201 bp, Homo sapiens
aagatgcggagcggagtttgcgtggcccggagcagctccagtgtctgaggcttctctgtgtcacaggctccaagcaggaagcgcaggcaaaatggcaaaayacagcatgtggcattcagttcaaaaatgcccttttttagaagtcggtattctaaatgacatccagtcttgcttagttttttaagagaaaggaaaaataat

SEQ ID NO: 2528 - DNA, 201 bp, Homo sapiens
gacagaacagggggtggaggcttccattcctgagctgcaaaggagtggggagggaggagcagtgtagtttgggaagtgtgtggtggagaaggcagatgggrcaggagctctgtcttgcatctctcaggtcagaaatgcctcagacatccagggggggcaagctaagatggagttgaacacagcagtgtagggctcagggga

SEQ ID NO: 2529 - DNA, 201 bp, Homo sapiens
tacttaaatacctacagccttataaggcctaggtgtcaattttttacgcttgcagatcttttacaactgtaagttaaatgattttacacattaagtgcatmtaaaacaaaaagattcaaacccaaatattaatttaatgacatgggtaatattttgctaaaagtaaaccactgctcagaatgtgaataaactgacctcgaa

SEQ ID NO: 2530 - DNA, 201 bp, Homo sapiens
cagttacccagtgagtctcctcaaagcaagtggcactgagatacaaccttcctacaggttttcaagtcatctcgtgtggtgcacagtcctcgccctacctsgaaggcccgggcgaagttttcctgagtgtgtatactcatctctttgtgttgtctctggcagggagcaagtgagtacaggattggagtaataggcattttt

SEQ ID NO: 2531 - DNA, 201 bp, Homo sapiens
caaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgaggg

SEQ ID NO: 2532 - DNA, 201 bp, Homo sapiens
ccttcctacaggttttcaagtcatctcgtgtggtgcacagtcctcgccctacctcgaaggcccgggcgaagttttcctgagtgtgtatactcatctctttrtgttgtctctggcagggagcaagtgagtacaggattggagtaataggcatttttaggcttgagatggctttgtgtgtttggttaatgtcactacatttcc

SEQ ID NO: 2533 - DNA, 201 bp, Homo sapiens
gaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctc

SEQ ID NO: 2534 - DNA, 201 bp, Homo sapiens
gaggtggccgagcttgtctggcttccagaggagctttctctgtcccgcccgggggagtggctcaccttggtctgagaccaatgggaggaagcctgctgcgrgcaactggtctgtgcctggaagttggacttgcattttctctggacctccaaagcaaacccgaatgaccactctcatcctccccttttgcttgtttgtgta

SEQ ID NO: 2535 - DNA, 201 bp, Homo sapiens
ccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagatt

SEQ ID NO: 2536 - DNA, 201 bp, Homo sapiens
gcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatcttt

SEQ ID NO: 2537 - DNA, 201 bp, Homo sapiens
aaagtgccagtctctctatgggttttagagctgatttagatacatgcattgctaatacagtcagcccagccaagatagtgccatcctccgcaagcatccamtaaggcatggagtcagcttccgtcattgttagatcagtacttgtttctttcccttgcttatttttcctaacctctctgaacctgctgtgttggaagctta

SEQ ID NO: 2538 - DNA, 201 bp, Homo sapiens
tttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtct

SEQ ID NO: 2539 - DNA, 201 bp, Homo sapiens
ccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcct

SEQ ID NO: 2540 - DNA, 201 bp, Homo sapiens
ttttattttcaagacaggttctcactctgtcacccaagctggagtgcagtgttgtgatcatggctcactgcagcctcaacctccagggctcaagtgattcytccaccttagcctcccaagtacctaggaacacaggcgcacaccaccactcacaactgactaatttttaaaattttttatacagacagggtcttgctgtgt

SEQ ID NO: 2541 - DNA, 201 bp, Homo sapiens
attaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtccttta

SEQ ID NO: 2542 - DNA, 201 bp, Homo sapiens
acccaagctggagtgcagtgttgtgatcatggctcactgcagcctcaacctccagggctcaagtgattcttccaccttagcctcccaagtacctaggaacrcaggcgcacaccaccactcacaactgactaatttttaaaattttttatacagacagggtcttgctgtgttgcccaggctgatcttgaattcctgggcaca

SEQ ID NO: 2543 - DNA, 201 bp, Homo sapiens
acacttctcatttttctggttagactacttaaccataacattcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccaga

SEQ ID NO: 2544 - DNA, 201 bp, Homo sapiens
accaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgt

SEQ ID NO: 2545 - DNA, 201 bp, Homo sapiens
agcaaatactctgcatgttgagtgctttcaaaatacagaaacaaacaacttgtggaggcattggaaaagtgtgtttgagaaacaagcagcctcaccatgartgggagtttgtttccctttctcgtctttctggtcatctgctgcacgggcaggaggagctgtgggttgcttttcttccttggaacatggagcaccactctc

SEQ ID NO: 2546 - DNA, 201 bp, Homo sapiens
aatgttctcatctctaaagtatggaaaataattgcatctgtgtgaaaactgagttactatacgtaaagtttttagaatagtacctgacatacagtaagtgytgaataagtatcagctagagagagagagagttagtttccagcagcctgtttctgtttggggtcacatgtggtctctgtccacctggctttttaggcctct

SEQ ID NO: 2547 - DNA, 201 bp, Homo sapiens
tgccccagggaggagtttgagttggtacatcctgactgggtactctgcctgtggttagcaaatactctgcatgttgagtgctttcaaaatacagaaacaarcaacttgtggaggcattggaaaagtgtgtttgagaaacaagcagcctcaccatgaatgggagtttgtttccctttctcgtctttctggtcatctgctgca

SEQ ID NO: 2548 - DNA, 201 bp, Homo sapiens
gtgctgggattaaggtatgagccaccttgcccggctaccggacagtccactctttacaggggggcgtcttggtataagtatggaaagctccgtagatgccrtgtcagtccataccctcaccaccttcttgaccctgtgccgataaactaagagatgtgggcagtgtaccatctggaaaggaaaaggctttggagccaggta

SEQ ID NO: 2549 - DNA, 201 bp, Homo sapiens
ccaggttcaagtgattcttgtgcctcagcctcccaagcagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattaca

SEQ ID NO: 2550 - DNA, 201 bp, Homo sapiens
tcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatga

SEQ ID NO: 2551 - DNA, 201 bp, Homo sapiens
catggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaa

SEQ ID NO: 2552 - DNA, 201 bp, Homo sapiens
ctttaaccagagagttggaggttgcagggagccgagatcgcaccactgcactccagcctgggtgacaaagcgagactccatctcaaaaaaaaaaaaaaatrcccacaactgggcatggtggctcatgcctgtaatcccagcactttgggaggctgaggcgggcagatcacgaggtcaggagatcgagaccatcctggctaa

SEQ ID NO: 2553 - DNA, 201 bp, Homo sapiens
tctccagtgtacatttatggaggggcaagatttcaccattctgtgaagaactctgcgtgttgacgactgctcacgcctagggaataaatttcagagcatgygtagatagtgccattttctacttaaaatactataatccattatttacttcggaaaataaaagcattaaggctgaaagttttgggttagtaatcttgatgt

SEQ ID NO: 2554 - DNA, 201 bp, Homo sapiens
acaactgttcgactaactgtcggagacaccctaatcaccccagccacaaacaaatagaacattgtatgtgtgctgaatcccacaaaggccagacatgatgscatgagaccaagaaggaaaagaaataatgtggaaagggtttggggtggaaaggtggggaacctggaggcgggccacatggggccccagaagccatgttga

SEQ ID NO: 2555 - DNA, 201 bp, Homo sapiens
tcatgcttctcaagtaaagcaacagtatctgtgtatccatttacttgattgagctttctactgaattacaggagttaaattatactttgttacactcttgrtattacaaaatgatggccatgcctttattataaaatgacaccagttattctttcctggaggatgtgccttgtgtcactagccgcactaagcacttcccca

SEQ ID NO: 2556 - DNA, 201 bp, Homo sapiens
ggcacctggctgtgctcccttgttggggggtcccttggcctgggcagttttgcgcttctccctgtttccctgtgccctgagactttgtgggtcacaggcargggggctggcctccctgatcaagggcccttggcctaggagggcccctggatttatctagtccagcttctcgtcgtccaggtgcaaaactgatgctctgag

SEQ ID NO: 2557 - DNA, 201 bp, Homo sapiens
tggcagggagcaagtgagtacaggattggagtaataggcatttttaggcttgagatggctttgtgtgtttggttaatgtcactacatttcctaggggatartaaaagtctagcatgataaaagatctcgtcttacaaggtcccgatgtaaagtttggagcctaacttagaatttaaaataaaatacattttgacccattgt

SEQ ID NO: 2558 - DNA, 201 bp, Homo sapiens
gagggtaacatggaagtattgtcattctcggggctgactggttgacagcagcctatacaggagtggagaatattgacagggctgcccgttctccccaggtygaagagagcaaatgcacatccctgtgtgcacggccacctggttcctctcctcacttgctggtgagtattgaacggctcacataattaggcagaactcagg

SEQ ID NO: 2559 - DNA, 201 bp, Homo sapiens
agctaaatcaccgctaagatttataatttactttttggatatctgaaacatcaacaatatagccatccatggcgtgttcctctggagtgtggtccgtgccrtctctgcctgctccatctggctgatcccaggcaggcagctcagctctcagcagacacagatccccagcacatatgaacgtgaaagaggcttctccgtggg

SEQ ID NO: 2560 - DNA, 201 bp, Homo sapiens
cagtcccagtgccttttctctggtgcagcctcatggttcggtctcaccttcagcttttccttccctccaatacatcctgtaaattattgtcagacttcttyttatctaaataactcgtttaggtaaggtactcatatgttcaaaataccatggtggctccctgttctctgtgatgtgaagtcctaaccattagactcagct

SEQ ID NO: 2561 - DNA, 201 bp, Homo sapiens
ctcggcattctttcccatgctttttccttgatcatcacttactagctaacatctattttttcctaaacactctgttgcagttgtagtctgcagtcactctyctaagacttgatcatctattacgctgtttcgttctttattttttaacttttcttcttcttttttttttttgaaacggattctcgctctgtcacccatgct

SEQ ID NO: 2562 - DNA, 201 bp, Homo sapiens
tggtgacagcaggttaaggagagtgtcagagctggtgcagagttttgccccggggccatgaggttctgggcatcatgactctcttatgaagttacaaaackgggcaagtgattgaaggcagaaagacactgtaataaagtgtgctccagtgatgtgtgctccggcttctctcccttactcatctgggccaggtgctttcgc

SEQ ID NO: 2563 - DNA, 201 bp, Homo sapiens
cactcgccttggggggatggtatgagctgtcatactgtatgagcctcatcctggggccatgacttaccaagccagatcatctctgtgagtctgcctggtgkaaagacaaggatcagtgacttctttgtaggtctgaactgggtaatgcagagcatgccctggagacatggcatgtccccccaattctccaagacatgacag

SEQ ID NO: 2564 - DNA, 201 bp, Homo sapiens
catgctttttccttgatcatcacttactagctaacatctattttttcctaaacactctgttgcagttgtagtctgcagtcactctcctaagacttgatcayctattacgctgtttcgttctttattttttaacttttcttcttcttttttttttttgaaacggattctcgctctgtcacccatgctggagtgtactggcac

SEQ ID NO: 2565 - DNA, 201 bp, Homo sapiens
cgattgaggcacctctgaaaagtccaaaactcactcccttcctctccagtttcaggcacagaataaaaattcagaacacatggccttggtcctggctctgyggctggctgcctgtggtcctcagacagctgctgcaggttcctgggcctcagtgtcctcaatataaaataagagggtgggacaagattactgaagtccctt

SEQ ID NO: 2566 - DNA, 201 bp, Homo sapiens
tgaaatcagggggattcccaaatttctaccccaaatctggatgactgcatattgcgggagttcagtaaatatttgttgcactaatacttatgtgcatacgytgaaataatctaaatatttaaaaaccaaactaacggtaggactttcctcagggatttaacgtttgctgtagaagactgaatgatagaatatataagctgt

SEQ ID NO: 2567 - DNA, 201 bp, Homo sapiens
ctcactcccttcctctccagtttcaggcacagaataaaaattcagaacacatggccttggtcctggctctgtggctggctgcctgtggtcctcagacagcygctgcaggttcctgggcctcagtgtcctcaatataaaataagagggtgggacaagattactgaagtccctttcagaactaaaattcacctttagattggt

SEQ ID NO: 2568 - DNA, 201 bp, Homo sapiens
agagcaaatgacttggaaaacaggcaaatccactgacataggcatttttagccaccttggaatccgaggagggattctgcactatgccctgtaacctcgtycacatgccgtttgaatgtataccatgaagaccccttagctcagggagctttgctctatttaagtaatgtttatattcttaatgaaccaaagaggaagtgg

SEQ ID NO: 2569 - DNA, 201 bp, Homo sapiens
ttctctaggaatcatctgtaaaaagtagaggtttgtcatatctctaaactagggattcaccttatttattaagctatcagtgactttatcttgaggtgcayggcttttagtaactctggttcaagtgcaaggaatgcaaagttaagtgtatcattggaggtgggatttttgagtttgtcagtcatttattgatttgcatgt

SEQ ID NO: 2570 - DNA, 201 bp, Homo sapiens
ctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctga

SEQ ID NO: 2571 - DNA, 201 bp, Homo sapiens
attatgtgtaggggactagatggaaagagtgcagataggactacctaccattcacccctaccagcgaagtggaagcactcatcttctttcccttcttaccytttcaaagcaagttgttgagggatgaagaggagagtgactttaatcgtggctttaagtagagattttctttaggagtaattgtttctctcgacagagtgg

SEQ ID NO: 2572 - DNA, 201 bp, Homo sapiens
taatacggttatcaaaacagtgttcactccatactccagtgctgttaatctccagactgaattcggatttcactattttcccactgatgtccctttttttkgttccagatccaagagacgatcctacctggcatttattgtgttcagtttttctaattctgggacgttttcctgggttttctttagtcattcacgaagttc

SEQ ID NO: 2573 - DNA, 201 bp, Homo sapiens
caaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcac

SEQ ID NO: 2574 - DNA, 201 bp, Homo sapiens
cccccaaattccatcactgagggaataagtaagttagggtgatagctcccaagcttattttctcttcagaatcacctcatgaagaaaatgaaggtctgtgkgatagtagctggcaggtgggcatggtggtgagggtggtgtttgagcggagacctgaatgaaggttgagaaggagccagccactcacagacacagaggagg

SEQ ID NO: 2575 - DNA, 201 bp, Homo sapiens
ttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttga

SEQ ID NO: 2576 - DNA, 201 bp, Homo sapiens
caggaacacagcggctgaggaacggatgcttggagaggagggggtgctttacatgccaggcgggcagggccggggtggggccagatgctggaggagagggytggccaaggggtggcagagaggccccccaggtggcaagtttgcaccctgttgcttcctgcaaggagcttttgtttacgttttcagcttggacagtctggc

SEQ ID NO: 2577 - DNA, 201 bp, Homo sapiens
ggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcct

SEQ ID NO: 2578 - DNA, 201 bp, Homo sapiens
ttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaata

SEQ ID NO: 2579 - DNA, 201 bp, Homo sapiens
aagaggaacgtgcctgggaggacccgagacaggtgcgggtgggtttccgcagtagccgctgatcccgagtgcatgcggcgtgttcccgggtcgggaccgcrgccaagggaggcttcccggccccagcctccaccccctcctcggcgccccgggacccggacacgccccccgagcttcggagacccgcagcgtgcacgcgcc

SEQ ID NO: 2580 - DNA, 201 bp, Homo sapiens
actacataagatgtgctgttcctctctctttctgtttgaaagtgacttggcagggtgaagttgagaaccccttggaaaggaggaagccgaaatgcaaacamagttgaatcatgaagtgatgtcactctgaaccaattggagcagtggtgtcatgtgcctggcagctacttcaaatgcccacaaaacaggagtaatggttta

SEQ ID NO: 2581 - DNA, 201 bp, Homo sapiens
ttttagaggcaggatcttgctgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctaccca

SEQ ID NO: 2582 - DNA, 201 bp, Homo sapiens
aagtaatcctccacctcagcctcctgagtagctgggactactggtatgcgccaccatgcctggctaagttttttctttttcttttagaggcaggatcttgytgtgttgcccaggctggtctcaaactcatgacctcaagtgatcctcccaccttcacctcccaaagtgctggcattgcaggcgtgagccaccatgcctgac

SEQ ID NO: 2583 - DNA, 201 bp, Homo sapiens
tgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatc

SEQ ID NO: 2584 - DNA, 201 bp, Homo sapiens
gttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatca

SEQ ID NO: 2585 - DNA, 201 bp, Homo sapiens
tcacagctccaggaacttgcaaggaaagggactaacggggcatctgattcacccgtgtgcccttaatggcgtattgtgtgaataaagcaacaatttttagyacagggatttaaaacaacttctgcaaagacagaactaaaaattaatcttaaaaggtggagggttggggtggagggcaggaaagaggaggaactaaattgc

SEQ ID NO: 2586 - DNA, 201 bp, Homo sapiens
tctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcata

SEQ ID NO: 2587 - DNA, 201 bp, Homo sapiens
tgttttggttcatttgtagtttccccccgcttcgttgtttcctcagatatggagaataaagcctggctggtcagtttcagtttttatttaaattcattttrtcttcattccttttaatctagcacagtcctgtgatgtattgggatcacagtgctctggggaaacattgaaatataaaaacattttcctgaaaacatttcc

SEQ ID NO: 2588 - DNA, 201 bp, Homo sapiens
ctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatag

SEQ ID NO: 2589 - DNA, 201 bp, Homo sapiens
atggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagct

SEQ ID NO: 2590 - DNA, 201 bp, Homo sapiens
tggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctc

SEQ ID NO: 2591 - DNA, 201 bp, Homo sapiens
gaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcac

SEQ ID NO: 2592 - DNA, 201 bp, Homo sapiens
aattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcact

SEQ ID NO: 2593 - DNA, 201 bp, Homo sapiens
ttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatt

SEQ ID NO: 2594 - DNA, 201 bp, Homo sapiens
tgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcattt

SEQ ID NO: 2595 - DNA, 201 bp, Homo sapiens
gtcaagtgggcatcccgcaaggatgcagcaggagtattagggaggcgatcaccagagcagaggaggagtaaccttccccataaacaagatgtgttcccccsactaagaaagcgggtggagggtggaggagccaaaacacatcccagccccggggccccaccggagcgaagcgggccgagcgcagagtgcagagtcggggaa

SEQ ID NO: 2596 - DNA, 201 bp, Homo sapiens
ctgggtgtcccctgcctgagatgagcacagtgatgtctatgcgaggttgtaggactcagtgaagtgccttagggattttgcctggcactctcctgggctcmtgaggtgcctagggctgagacttccccttctctgtctggtaaatcatctctcccattctttcttctgcggcccttcatatgagctttgtaatttactcag

SEQ ID NO: 2597 - DNA, 201 bp, Homo sapiens
gtgatttccccgcagcctcggtttagagggagacggggtgtgctgagctgtgcctgcttctgtagaaggggccttctccaagtctgagtagccttaagccwttaggactgctgagtctttctccacaaaaatatgtgggaggcctgcagggcaggtgctcaactaagctctggggctgcaaagatccagagccatgcccct

SEQ ID NO: 2598 - DNA, 201 bp, Homo sapiens
attatgcataatacagtgataccctcaaggctgagtgggaggcagtttgccctctgctgaaggtttcttgtgcttattgtgttcttatggtttggttttaycatttttatgtctccatttctgtttaatagacttatttcagtaagaagagaaagccgtctccatcagcccctctgtaggtgattatttgccacttccttt

SEQ ID NO: 2599 - DNA, 201 bp, Homo sapiens
gtgcttattgtgttcttatggtttggttttaccatttttatgtctccatttctgtttaatagacttatttcagtaagaagagaaagccgtctccatcagcmcctctgtaggtgattatttgccacttcctttttgctgtgagtgctttgaaaacagatttctaagcttgttagagttatgtgttaagagtaaataggcagt

SEQ ID NO: 2600 - DNA, 201 bp, Homo sapiens
taaaataagagggtgggacaagattactgaagtccctttcagaactaaaattcacctttagattggtcagatttaaactttttctttctagctcatgtcargtattaaaatgtgtgcacttaccctgcagtttcattatattcaacctgctcccccgaccaagtttcacttacgtatctcactacgagtaggtgtatatgt

SEQ ID NO: 2601 - DNA, 201 bp, Homo sapiens
ctgggaaatttctgctaatgcaataaagatttttgctgttgaaagaatttgatctgttttatgtataacatgcagagagcagaagcatatattatctgtarcagatgatagagcagggtatatgggcaagttagaaaaacacagttctcactacatttgaagaaaaaggacaaggagttgtcacaaggatccaggagagtc

SEQ ID NO: 2602 - DNA, 201 bp, Homo sapiens
ctgcaaagaggaatgcttatccctgttacttattcctggtttcctccaagactagtttcagctggacttcagttgccaaggacttgtcttctgtaatgccsacagaaaataataatgccacattgtaaggtgaaaacagtaatcctggtatttttgtattttagaagaaggttgaagggaaagaaaaggattaaataattt

SEQ ID NO: 2603 - DNA, 201 bp, Homo sapiens
aattaacacctgtctctatctgtgtgtaaggctctctgggaggagctgtgaggcaaataaaaataaggaatggtgtcccgcaaggagcttacaatgtgtgyattacaagtatatactgagcatggccctgggaacacagtgaaaaaacaggattcctgccctagtacagtgtacactagtggaagagagagaggcagtaaa

SEQ ID NO: 2604 - DNA, 201 bp, Homo sapiens
taatgccacattgtaaggtgaaaacagtaatcctggtatttttgtattttagaagaaggttgaagggaaagaaaaggattaaataatttataacgatgctyttatgggaaataaaatataccatgtccatttggaaacacatttgcttacttccacacagcctttgtaacgtgctctccttcctcttacctgtacttcggt

SEQ ID NO: 2605 - DNA, 201 bp, Homo sapiens
tgagaaaagcaggtgggcaatgtactcctgacatactcccttccgttgcaatggccttgagtgatggagcaagagtgaaggaatgttcccatggcactggyaccaggatgactttttgtgaagcagagcagttggtcttagatagtggaggtgcgggaggcatgagaactgggcagtctgacggctgcaccagccagttgg

SEQ ID NO: 2606 - DNA, 201 bp, Homo sapiens
acgcctctgtctctgtcccccgccgccaccacacagatgcacgtactctcttcacttccgtgtacccagtaaatgcagatcctgatttaaatctgcagcaygctgctttcttcccattgcatgtgggaagcttcaggttctcttcggtttattttctcatcacctttattaaaatgcagtaaagcaaggagtatattaatg

SEQ ID NO: 2607 - DNA, 201 bp, Homo sapiens
gtttttacattttccttaggcacagagaaactagtatctttctctgggttgcctttttttttggagacagaatcttactctgtcatccaggctggagtgcrgtggcctgatctcggctcactgcagcctctgccttccgagttccagcaattctcctgcctcagccttccaggtagctgggattacaggcacgtgccacca

SEQ ID NO: 2608 - DNA, 201 bp, Homo sapiens
tctgtgttctgaacctggagtacaggcagacacagccgcatcccagaagctcaagagtgcccataccaggaaattacagaaatctttgccaaatggatgartgaatgcaacttccttgatacagggtcagagaggggaaatctgagaaaagcaggtgggcaatgtactcctgacatactcccttccgttgcaatggccttg

SEQ ID NO: 2609 - DNA, 201 bp, Homo sapiens
catcgaaaaaacaaaacattctgcagagggcagtcatgtgtccgctgtgcctctgctcctgtgtgcaccataaaacttgaaagtgagccagaatttgaaartatcggattgggatgtgatttctttaagcctctggctaatttaatataaagtgtttacacttcatttttctggcagtggattttctatgtaggtggtgga

SEQ ID NO: 2610 - DNA, 201 bp, Homo sapiens
ctgccatccccatgctctgcctcctaagcagaggatgaacttaagcatcttaaaattttaaacattgactttccctaaaaccaattaaaaaaaaaaacaaracagacagacagacatgacttgtgcccttaaaaatgcagccaggctggcatataaatgggcgtaggctgtttctaaattttttgctttaaattttgccag

SEQ ID NO: 2611 - DNA, 201 bp, Homo sapiens
catggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgtaaagacaaggatcagtgacttc

SEQ ID NO: 2612 - DNA, 201 bp, Homo sapiens
tatagtggtggcattctgcctaagtcatcttgaaaactgaatgcaaaatctttttaatagctccataatggtctcttgaagtgttacagatttttataacratagctgtaatacaagtgcctttatttactgtgagacttgaacattttgaccatttacatgggtacttgtgtgtctccagctgagctgagtgcatgtcgc

SEQ ID NO: 2613 - DNA, 201 bp, Homo sapiens
ctctgagtgtttttaggaattgcaaaatgctggagcctgcatccattttgagagctacaatatcaataaaaatacttctttcttcgattaaaatacttctmattttaaaaattaaaatagctgtagtagtctttaaagagtaaccatgatcacagttttccatggcaaaataatcattgataggggacttacgattaatgt

SEQ ID NO: 2614 - DNA, 201 bp, Homo sapiens
cccgtccccacaatatcttagggcgaagaaaagcaggtttgagaaaagctttttttcatcatgtatttgtaatagctggagcctgctgagatgatgaggtrgagtggagggagaaagagaccttgaggaggtgtggagggggaaggggtggaaagttctgtcgtcttctgtgcctctctctctctcttgctcagggtctcc

SEQ ID NO: 2615 - DNA, 201 bp, Homo sapiens
gcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttg

SEQ ID NO: 2616 - DNA, 201 bp, Homo sapiens
agtctcctcaaagcaagtggcactgagatacaaccttcctacaggttttcaagtcatctcgtgtggtgcacagtcctcgccctacctcgaaggcccgggcraagttttcctgagtgtgtatactcatctctttgtgttgtctctggcagggagcaagtgagtacaggattggagtaataggcatttttaggcttgagatgg

SEQ ID NO: 2617 - DNA, 201 bp, Homo sapiens
catacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgc

SEQ ID NO: 2618 - DNA, 201 bp, Homo sapiens
ctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgcgaccgacacacagcacaagcgtcatcctgttctgcctgtccc

SEQ ID NO: 2619 - DNA, 201 bp, Homo sapiens
aaatagagttatagtgctacaatgagataaatttcacaggtaaatgtgacgtagctaatgcataatcattctttgtgttgcatggcaattctgtacaaatrgaaggtagcatgtttaacgttcctgttatttcacataaatacagactgagagtttcagtggtctggtttgaaagggaagaaatagaagaaggaaggagag

SEQ ID NO: 2620 - DNA, 201 bp, Homo sapiens
cctgggggtgtgtgggggtggttggttggggtttgcttgttagtttgttgtaaaagcccagcttttcattcttggaaagatttcagccaactcgagagggttacctgccaggaatgctgcagaagcaagaactcagtgggtgagcacttccatttcttcaacaaatgcttctgagtccctgacctgtgccaggtgctcttc

SEQ ID NO: 2621 - DNA, 201 bp, Homo sapiens
aatttgaaacacccgtgtaaactacctttggcaaataggatagctaaatcaccgctaagatttataatttactttttggatatctgaaacatcaacaatayagccatccatggcgtgttcctctggagtgtggtccgtgccgtctctgcctgctccatctggctgatcccaggcaggcagctcagctctcagcagacacag

SEQ ID NO: 2622 - DNA, 201 bp, Homo sapiens
atttacttaataattgtgtctattgaatgtattcttatacatacacacaggcatgcacacacggacacgaatataagctttacaaggacagaaaccttatyttttatttatttcttccttgtgtatcctgagcactgagaacagcctggcacaaagcagggctcaggaaatgtttgctgaatgcatgttcacactggatgt

SEQ ID NO: 2623 - DNA, 201 bp, Homo sapiens
gcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagattt

SEQ ID NO: 2624 - DNA, 201 bp, Homo sapiens
cttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttc

SEQ ID NO: 2625 - DNA, 201 bp, Homo sapiens
agaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcact

SEQ ID NO: 2626 - DNA, 201 bp, Homo sapiens
tgcactgcttcctgctgggggcagaacaaagagagcgggcattgtctctggcataaatgaacctctatcaaaacaaacacccagagagaggggcagcctgrttacagctgcctgtgtgagcctcgacagtgggcctcattcctcacaaagggagctttgaggcccggaagaggcctttccttgatgatcgagctgtgcaca

SEQ ID NO: 2627 - DNA, 201 bp, Homo sapiens
gaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactg

SEQ ID NO: 2628 - DNA, 201 bp, Homo sapiens
aagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgc

SEQ ID NO: 2629 - DNA, 201 bp, Homo sapiens
ggtttagaaatttcaaaggatgggggttgagggagggaggagttatgggcatgtgatgtggacagggcgggcaggaggatggaagtaacaggtccaaaatrtatctttggtggcccggcagagctcttgcatggggtgagaatggtaatttaggaagagcaagtcttcccatctgtgaagcagaagaaaaaagtggactta

SEQ ID NO: 2630 - DNA, 201 bp, Homo sapiens
gtgtacctgtgattttatcactgcacattcatagaaaggttacagggctaatcttcccgtgatatgaatcatgaaagtcaaaatttatgaatgaaaataaraaggaatgaagtactgatatatgccacaccagagataaatattgaaaacattacctatgctaagtaaaagaagccagtcacaaaagacactacctattgt

SEQ ID NO: 2631 - DNA, 201 bp, Homo sapiens
acacgcctgacgagcgggaatgtgagcgttgtttctgtaaccagttttactgaacctcacagatccattatacgacgtgaattttgtgggaataacatagrctgggagtctgctctcttccagcctggtccctctcttctttcagccctaccctctctgatcatcatgtcccttgcactgcggccaggtaacctttctgat

SEQ ID NO: 2632 - DNA, 201 bp, Homo sapiens
gtcacagctttaaaagttcagattttaaaaaggtaaggaaatgatctcctagtgagacaacttctgcctaaaaaataaaagcttctaagacataaattctrtgttatgaacaacttgcaattttcatagttttcagttttagctctggcagcctctgatagatcttaaatatgtttatcacagctggaaaaatgttttatt

SEQ ID NO: 2633 - DNA, 201 bp, Homo sapiens
aattcacaatcttttatgccaaaagaaagctttcagaatggcttgtcttttttgtagatacttgtatttatatgtccatgcacatacataagaaaggaccrgggaaggtctgcttgaagatattaataaaggggtcacttgtgggtaggtggacttacttgttctctatattctctttacttgtttgtgatctctggtttt

SEQ ID NO: 2634 - DNA, 201 bp, Homo sapiens
tattctacaaatataaaaatatcgttagaaaagtaggtgttaattttaaatataatttttgctgcagcttatgaagtacattgaggaagtgtttataaagrggattctttttctagtgtattatttggagacgcagcttctactgtaggcttaccttcaaatcaaagataatacattcttttatagtattagatgtagagc

SEQ ID NO: 2635 - DNA, 201 bp, Homo sapiens
cagcctttaggtttgtgtttttacttcggtcttttaatctgcctaataaaaacacacataacatcagggctgctcaggaaaccacctgcttttaccaggaytctcatcttcccactatgatacaatgatagtttagaaaaataccaaatatttatcctgagaaactgcaggggagatttaacacccaaaagaagctatttc

SEQ ID NO: 2636 - DNA, 201 bp, Homo sapiens
cagcttaccatcctattacacacacatcgcataagttcgtattatttgtcttgtttggaaatcagtccaactttctgacccttgttctatatataactatrgatcccaaaggttcagctgctgggctagcattttgtctgctatttcctaaataatggtaggtaagcaggaaaagtgccagtcttacttgtccctgactct

SEQ ID NO: 2637 - DNA, 201 bp, Homo sapiens
atgagaaggacttggtgcaggaaagcagcagcacgtgcctggcacagggcagggcctctccagatggcagttcctgtctgtgtcttattcccaccctccgrgcacatggggggaactcagtttctccccactgcgcgtcaccctgggagaggtgttttttgtgccaattgccattttaaatccaaatcagcagggatcatg

SEQ ID NO: 2638 - DNA, 201 bp, Homo sapiens
gatccttcaactctgacaaccttggctttccaaaatgtcactgagatccccctcaaaaagtctcctgagccatccagaacagaaaattcaagcattttacmtagagtagagctcttattcctcactcagagcctgttgacttttatatcgcactcggcgtgagctgattttgtaacccagttacaaaagccatagccatgg

SEQ ID NO: 2639 - DNA, 201 bp, Homo sapiens
ttgcttgcaactcagatatccagcccactgatccaggaagagattcctttgacctgggaagtcataatggcagatatttagacccagctctcaagcaagcmtccaagttgttccggtgaacccgtaactttgagtaacctctgattgaaccagagagtaggaactaggtgcagaaccttgttgaatagaattgtttagcat

SEQ ID NO: 2640 - DNA, 201 bp, Homo sapiens
agcccttactgaaaggaaagaactgttgacttacaagtttttgctaccggtttggtggtcactaatgtgtccagaggcctgaagatgggcgtgtgaggagsctgacttagcttcagaggctctgtctttcgactcacttgtgtgctcactgcacccctgtgctggcaggactccaacctccacccccagcacttgtgtgga

SEQ ID NO: 2641 - DNA, 201 bp, Homo sapiens
agtcctcttgcctggatgagaggcccaagagcactgcatgttagtggctcttcctcctcccccacacctccagggactggagctggggctgctcagaatgmaagatgaatgggggagggagaaggcccagggttgaccccccacaagcttgtctccctgtctcatgctgtctcctatcccatcatgctgctgattgggcag

SEQ ID NO: 2642 - DNA, 201 bp, Homo sapiens
agttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgca

SEQ ID NO: 2643 - DNA, 201 bp, Homo sapiens
agctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattc

SEQ ID NO: 2644 - DNA, 201 bp, Homo sapiens
gagaccatggcacgcatgctgtgtgtcgaaggccaggtccgcctgtctgcctctccagcagatactctctggggctatttttttctgcttggttgtcatcytttggtttaaccaggcgccagggctcaggcctggacctgctggattccaaagaagacttcgaggtggccgagcttgtctggcttccagaggagctttctc

SEQ ID NO: 2645 - DNA, 201 bp, Homo sapiens
tgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaa

SEQ ID NO: 2646 - DNA, 201 bp, Homo sapiens
gttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggag

SEQ ID NO: 2647 - DNA, 201 bp, Homo sapiens
ccttcaccaatttttaaattttttgtagaaactcactatgttgcccagtctggtctcgaactcctggcctcccacctcagcctcccaaccacaactggccraggtcctgtttctcatcacattgtcactcactgatcttgtcatgctttggtggagcttatctacaataattattactgccatgctttaatggcaattttc

SEQ ID NO: 2648 - DNA, 201 bp, Homo sapiens
taaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgc

SEQ ID NO: 2649 - DNA, 201 bp, Homo sapiens
gtcagagtgcagtagcatgatctcggctcactgcaacctctacctcctgggttcaagtgattctcatccctcagtttcccaagtagctgggatttcaggcrcgtaccaccatgcctggctattatttgcatttttagtaaagacagggttttaccatgttggctaggctggtctcgaactcctgacctcaagtgatccttc

SEQ ID NO: 2650 - DNA, 201 bp, Homo sapiens
gacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttact

SEQ ID NO: 2651 - DNA, 201 bp, Homo sapiens
aaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgcc

SEQ ID NO: 2652 - DNA, 201 bp, Homo sapiens
aaaaaaagttgtgcttaagctaagtttaatttattattgaagaaagaaatttttaaataaatttagtgaggcctaggtatacagtatttataaagtctacrgtagtgtacagtaatgtcctcagccttcacattcactcaccactcactgactcacccgagggagcaacttccagtcctgcaagctttattcgtggtggta

SEQ ID NO: 2653 - DNA, 201 bp, Homo sapiens
agccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgcca

SEQ ID NO: 2654 - DNA, 201 bp, Homo sapiens
ctattttcccactgatgtccctttttttggttccagatccaagagacgatcctacctggcatttattgtgttcagtttttctaattctgggacgttttcckgggttttctttagtcattcacgaagttcgcacttttggagaacatggggccagttattttgtagaatatctttctgttagagtttgtggatgtttcctcc

SEQ ID NO: 2655 - DNA, 201 bp, Homo sapiens
tatggtcaaattggcaacgaccacaccacatgagaaggaagattattcttcctggaacctggctcccttgagattcttttttttttttttttttagacggmgtttcgcccttgttgcccaggctggagtgcaatggcacgatctccggctcaccgcaacctccacctctcgggttcaagcgattctcctgcctcagcctcc

SEQ ID NO: 2656 - DNA, 201 bp, Homo sapiens
aaaaccttttgctgtgcacgcctgctccttcctccactcctaccccatctccatgaccctgtaagtggccacagtcatgtcactgggtaaagtgcttattraaacaaaattggcacaggcttctgatcctgcgtgtgggttggtgtagcagaggttcagtgcaacagaagaagtttttcatcttaaaatttggaagtaacc

SEQ ID NO: 2657 - DNA, 201 bp, Homo sapiens
tggggtcctgtggcggtgaaggggcgagtctgcacccaggcgagtgttaaaggcctggcctagagaagatgggtgttttgatggaaggagctgctgggaascatgtgtactcggtgtcttggagtttagaaacctcagttggctccatgtctcgtccttagtaaaggaatatcgggagctgagactggatgtattgacaca

SEQ ID NO: 2658 - DNA, 201 bp, Homo sapiens
cttggcagcaggctttttttgttgagggactggggagaaaggaggatcttgtggcatcttgagacgtgcaagttttgtggttggtgtattctgaaccctcygctgtgtgagcagcccgctcaggggcagtgtacgtggctgatctccactgtcctgcccgcgtggatgggggggttattctcagtgtacgtggctgatctc

SEQ ID NO: 2659 - DNA, 201 bp, Homo sapiens
cattcccttccgactagggtcatacgctcgtggctcattcacattccccttggtaataactaatgagggccattcagttaagtggctgggaaggtctgacrtggaagttgggtgatcctcaatggttatttccttttttgctctttctagcatttttatatccagaccttttgagtgagtcggattagggtgaggggttgg

SEQ ID NO: 2660 - DNA, 201 bp, Homo sapiens
aacaaacttattgccacccaggtcgacaggtgggaacagtgtcaccttatttgaacttaatttattcggcctttgagaagcacttatagccagtttcctcraggggcaacaaaatgacattgcagttcaaaagtgctttaaaaacttctttttcccaaagctataatctgcatgtcaccattctccagagtacattgaaaa

SEQ ID NO: 2661 - DNA, 201 bp, Homo sapiens
ctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctcccctt

SEQ ID NO: 2662 - DNA, 201 bp, Homo sapiens
acttactctcctctgacaagcacccgcctcttcttcaggggtgcaagccacctatgccagctggagggcagagttccattcgtgaaacccttgaaacataygtactatgaaatacaaaaatgtgtaggaaagaaaacaagattattaatgaagttcatattggacacccctcagaggtctaaaatgatggtgcccctcctg

SEQ ID NO: 2663 - DNA, 201 bp, Homo sapiens
ccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatataca

SEQ ID NO: 2664 - DNA, 201 bp, Homo sapiens
aacccacggtgcccagattgaacaaagatgatatgcaaacctcgaaagaaattggcatggaaaaaaaaaatccaaaattctcatgtgaatttttttaaatstccaacagaataatccagtcctagcacctccaagcctgagcaagatgattcagatggccggagagattgcagacggcatggcatacctcaacgccaataa

SEQ ID NO: 2665 - DNA, 201 bp, Homo sapiens
gtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaa

SEQ ID NO: 2666 - DNA, 201 bp, Homo sapiens
actgggcacggtccctgaggctggctctccagacgtttgaggcatttcttggtagaacacctcttagcattggttacagaaataattaagacaatgtcttyaggagattttgacttgggaataaaactcactgtccaaccttgcattcatccctccaattttcctagcttttaaggagcattgctccccttccagggaccc

SEQ ID NO: 2667 - DNA, 201 bp, Homo sapiens
tctccagacgtttgaggcatttcttggtagaacacctcttagcattggttacagaaataattaagacaatgtcttcaggagattttgacttgggaataaarctcactgtccaaccttgcattcatccctccaattttcctagcttttaaggagcattgctccccttccagggacccacattggtttctaagaggcaagctg

SEQ ID NO: 2668 - DNA, 201 bp, Homo sapiens
atcaacaaggagattttgtcctgtaactaactcaggtacctggaagcagcccgacatttgggggtgcatcgctgcagtctcctttggagctggagaaaccyatgagcaagaatgggcttatgacacatccatttccactccatccctccttccgttgtatgactgcatggagcccctctgacctccagcagtgtcacctgc

SEQ ID NO: 2669 - DNA, 201 bp, Homo sapiens
acgggcattgcagggggactcacagccgccggtcttccccctggggaaacaacgtcaaggttcctaattagaaagggctttacacagagacatgtatctamtgtttgaagattaaatctgtccatgaaatggaagacttgattttatatgaagtcatgaagagccaacaccacatagtaaaataccggctttgaaaaacac

SEQ ID NO: 2670 - DNA, 201 bp, Homo sapiens
tcctgtaactaactcaggtacctggaagcagcccgacatttgggggtgcatcgctgcagtctcctttggagctggagaaacctatgagcaagaatgggctwatgacacatccatttccactccatccctccttccgttgtatgactgcatggagcccctctgacctccagcagtgtcacctgcagcctggtagtgagaaac

SEQ ID NO: 2671 - DNA, 201 bp, Homo sapiens
agccgtgtttcccggctaggcgcgaggactcggtagggaagttggtgccggggcgggctccgcggttcccgggccccgcgacccgcacctcgccccttccrtgcgcacgagcctctccgcacacagcgctgatccccctgcggcgcgcaggcagcagcgacagcaccctgggccgcaccgcgtctccgctgctggggctga

SEQ ID NO: 2672 - DNA, 201 bp, Homo sapiens
tttcccggctaggcgcgaggactcggtagggaagttggtgccggggcgggctccgcggttcccgggccccgcgacccgcacctcgccccttccgtgcgcamgagcctctccgcacacagcgctgatccccctgcggcgcgcaggcagcagcgacagcaccctgggccgcaccgcgtctccgctgctggggctgaccgggca

SEQ ID NO: 2673 - DNA, 201 bp, Homo sapiens; identical to SEQ ID NO: 240

SEQ ID NO: 2674 - DNA, 201 bp, Homo sapiens; identical to SEQ ID NO: 242

SEQ ID NO: 2675 - DNA, 201 bp, Homo sapiens
cgtcctcagttttgtgaagcaacagcctctgtgcctctttctctgcatgctctgttgacggtctagtcttgagagagaacctgctgctgtcccgtctgtcrtagccttcctagcaactcttaggcctgcatgctgtgttttcatgatctcccccaaagcggcactttgatgttttttcagagtcaaagtatcactgtggat

SEQ ID NO: 2676 - DNA, 201 bp, Homo sapiens
tccacttgcacttgtgttaaaatgcggcagaactttccctctatacttaaattgtggtgaaatacgtatgacataaaacttaccatcttaacttttttttmttgagacaggatctcattctgtcacccaggctggagtgcggtggcgcgatctctgctcactgcaacctctgcctcctgggttcaggcgattctcatgcct

SEQ ID NO: 2677 - DNA, 201 bp, Homo sapiens
aagaatggagccaggtggctattttttttttttaaatttatgtaataacaaacattcgcatttattgaaaacttaaagtataataaaaaaataaataaaakaaaaaaagaaaaaagaaaacttattcctgtgtcaggcacttttctaagtgctttgcagtgtattgtctcatttaatagttgtttaaattaacagagtagg

SEQ ID NO: 2678 - DNA, 201 bp, Homo sapiens
tgtgcctctttctctgcatgctctgttgacggtctagtcttgagagagaacctgctgctgtcccgtctgtcgtagccttcctagcaactcttaggcctgcrtgctgtgttttcatgatctcccccaaagcggcactttgatgttttttcagagtcaaagtatcactgtggatatttatcccaaacaaaattgcaaactgat

SEQ ID NO: 2679 - DNA, 201 bp, Homo sapiens
tctatacttaaattgtggtgaaatacgtatgacataaaacttaccatcttaacttttttttattgagacaggatctcattctgtcacccaggctggagtgyggtggcgcgatctctgctcactgcaacctctgcctcctgggttcaggcgattctcatgcctcagccacccgagtagctggaattacacgcgcccgccacc

SEQ ID NO: 2680 - DNA, 201 bp, Homo sapiens
tgccatatgaaacgtcattaagtggagagttgttcacgaactaggtaggtagttactttggtcttgccataggtttttggctgtttctgatgagctactgwttgaagacccctggggtaggggtgaggcctgcattctgggtccaagtctaagagtggcgactagaaatgagcaagttatttaaattgcctgggccttggt

SEQ ID NO: 2681 - DNA, 201 bp, Homo sapiens
ggctggagtgcggtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctg

SEQ ID NO: 2682 - DNA, 201 bp, Homo sapiens
tggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaa

SEQ ID NO: 2683 - DNA, 201 bp, Homo sapiens
ttggtcagggtggtctcgaactcccatcctcaggtgatccacgcgcctcaccctcccaaagtgctgggattacaggcatgaaccaccgcactcccttgagrttcttgtaagccaaggcagaagaagagacatcttaaagtctgtatgtgcacacctgcctccccccattttatatacaattcaagggctttgcttttggaa

SEQ ID NO: 2684 - DNA, 201 bp, Homo sapiens
gaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatatt

SEQ ID NO: 2685 - DNA, 201 bp, Homo sapiens
ctttttagtaacagtaggctttgtcataattggcttcatgttccagctttcctaaaactgtaagtgatgttgggtgggccagcagcaaaataattcacttwacaatttgcatgatagtctggaatgaaccgaatacctaaaaccaggaaataatagtagatatttaatggtttggggatcaaataagaatttactcccaga

SEQ ID NO: 2686 - DNA, 201 bp, Homo sapiens
cttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatca

SEQ ID NO: 2687 - DNA, 201 bp, Homo sapiens
tgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaa

SEQ ID NO: 2688 - DNA, 201 bp, Homo sapiens
attcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaa

SEQ ID NO: 2689 - DNA, 201 bp, Homo sapiens
ctttttttctcctcctcatggtgggtggccctggtgggctctctctggggcctccagtcctccttccccacaacactggggaattgctgccagttgaatarggccctttttttttttttttttttttgagacagtcttgctctgttgcccaggctggagtgcagtggtgcaatctccgctcactgcaacctctgccttact

SEQ ID NO: 2690 - DNA, 201 bp, Homo sapiens
aaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactt

SEQ ID NO: 2691 - DNA, 201 bp, Homo sapiens
agagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgcagagccctggtaaacgt

SEQ ID NO: 2692 - DNA, 201 bp, Homo sapiens
acagccacagaattgaaatgagatacctgtttctgcttctggcattgggaaagaaagaaaaatggcactagcagccttttttttttttttttttttttttycccaaaaaatttgctactcttgaggttctgtcaaagaatgtgctgtggcctctagaagcatttttaaaaagagactttcacaagtgattgtgcaaaattg

SEQ ID NO: 2693 - DNA, 201 bp, Homo sapiens
tcaccttccttcagtgagacaggaataggacagtatttgaaaagcatctaacatgtttccaagcacataggtttttggtaaatggtggcagctgctgctattttttttttaaattaaactatctaagagttgcattctgagaccatctaaaattctgagtcttaagctgtgttgactatatatgttcactaccataactaa

SEQ ID NO: 2694 - DNA, 201 bp, Homo sapiens
gtttctttagatcttggaccttgaggtgacctctgtaatggatatatttgaaattattaactgtcttcaagtgggggtttgatgagagagagagagagagwgtgtgtgtgtgtgtgtgtgtgtgtgtgtgtgtgtttacagaaaatatgctaggtttgtacattcaaatttgtgttatcctcttcaagaaagtcaccttgg

SEQ ID NO: 2695 - DNA, 201 bp, Homo sapiens
ggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattg

SEQ ID NO: 2696 - DNA, 201 bp, Homo sapiens
tttctttagatcttggaccttgaggtgacctctgtaatggatatatttgaaattattaactgtcttcaagtgggggtttgatgagagagagagagagagaktgtgtgtgtgtgtgtgtgtgtgtgtgtgtgtgtttacagaaaatatgctaggtttgtacattcaaatttgtgttatcctcttcaagaaagtcaccttggt

SEQ ID NO: 2697 - DNA, 201 bp, Homo sapiens
gacaacttctgcctaaaaaataaaagcttctaagacataaattctgtgttatgaacaacttgcaattttcatagttttcagttttagctctggcagcctcwgatagatcttaaatatgtttatcacagctggaaaaatgttttattgtcatctttgtttatcataatatgccacctactctggttgtgtcttacaactgta

SEQ ID NO: 2698 - DNA, 201 bp, Homo sapiens
ggccaaggtgggcagatcccttgaggccatgggttcaagaccagcctgggcaacatgcaaaccccatctgtacaaaagattaaaaaaaaattagtttggcktggtggcacacacctgtagtctcagctccttgggagttgcaagtgggaggatcacctgagcccttgaggtcaaggccgaaataagccaaaatcgcctcac

SEQ ID NO: 2699 - DNA, 201 bp, Homo sapiens
acattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctgga

SEQ ID NO: 2700 - DNA, 201 bp, Homo sapiens
gactccgaggaggccaagggcatgggtgacagcaggcagactgctcgggtggaatgggcatcagctgcagggaagccgggggaagaacagggcacaaatcrgagttcagtgtgagacgcagtgagtttgtgggtagcccagtaactgggaacttggaatggagcagttgggccgggagggccagggtgggagccgtgccgt

SEQ ID NO: 2701 - DNA, 201 bp, Homo sapiens
caccaccggggctgaatttagtttacggggaacattagcagcaacagagggaggatgatatcccgcacttagcccagggcctggctcgctgtctgacaagyactgtcaccatagtaaggacagtttatctgctcgggatgtaagaagtgctggaaaggagggggcagcattgttcagtccatccctttccaagctcctcac

SEQ ID NO: 2702 - DNA, 201 bp, Homo sapiens
tccaagaaaagagtagaatgaaaggaggcaacttggtttcatagggagtgtcatgttgtccttctgagtttactgatgagcttacctgagaaaggagggtyctagcatgggagttctgttgctacaagacatgaaagaatggcctccgtttatcccggagaggagagtccctgagcccttgggagttgccttgaaacctct

SEQ ID NO: 2703 - DNA, 201 bp, Homo sapiens
ttaatatgtgaatgtatgtttcttatggaaattagaacaatacacagttacagagtagaaggtgataggtgatatagctcaccctctcctcttcctgctaytctccccagtctgcttcactccccggaaggaactactggcccatcagcatgtctccttccaggcattttttccatgtggttatgtccacctgcataagaa

SEQ ID NO: 2704 - DNA, 201 bp, Homo sapiens
acacggggcctctcgtttggtccagaacagcctggctcatcggctggggcttgcttgtgcagggctggagcgagcacgtgctagatggagacagcagactyggagtgtgcatttcttcgtgttgcaagcctggcctcacagtgccttcttcctttggttgtctgccaggggtagccctgcaccaggaggaagcttagaaat

SEQ ID NO: 2705 - DNA, 201 bp, Homo sapiens
aatccagagttaaaaataatgttcataaggaagggtagcaaaatttagattttaatacttataggaggtgtgttaattggccccagggccgcaggctttakcgttcagaggactttagccccaaaggttttgtggaacttttccagagtcctcaccagtacattgggaataaatggaatgcctttggaagtactttgaaga

SEQ ID NO: 2706 - DNA, 201 bp, Homo sapiens
tggggttttctgcctccctggtgcactgggcacagcggcttgcctgccttttgggtcgtctccacctcccagggatgtttttgttccctgatcgaatgacytcctgttttgtttgttttttgagacggagttttgctttgtcacccaggctggagtgcaatggcatgatctcggctaactgcaacctctgcctcccgggtt

SEQ ID NO: 2707 - DNA, 201 bp, Homo sapiens
atgagataaatttcacaggtaaatgtgacgtagctaatgcataatcattctttgtgttgcatggcaattctgtacaaatagaaggtagcatgtttaacgtycctgttatttcacataaatacagactgagagtttcagtggtctggtttgaaagggaagaaatagaagaaggaaggagagaagttggcagaggagcaatct

SEQ ID NO: 2708 - DNA, 201 bp, Homo sapiens
tgttggcatttctcgtggtatcatacatgttgggtgcttcccaaattaattacatcagtcagaaaacttcactctatctgagaagctttaatagtgtactkgggattattaaatcctaaaaaaggttatcacaaagagttttcttggtgtgtgtctgtgcttagaatttagaaaataagtcatccagtattgaggccattt

SEQ ID NO: 2709 - DNA, 201 bp, Homo sapiens
agtaatttagcttactgacaaaaagaaaagcaaaggaaattccagagaaagaacaggataccaagtctaaataaatttggaagacaaagagaatatcatartttagttcaatcttttaaacaaattgtcacaatttatacgttgggataagagaaccatgagaaaaggtatattctaagtcctgaacatctttctataccc

SEQ ID NO: 2710 - DNA, 201 bp, Homo sapiens
cattaagatggccattcgaaaacattaagcacagaagaatcccattcaggtaatcttctgttggctggctgtagaactacggagaacatctggagaaacaygtcaagggtgtgtgtgaaatcgttgagcctactcgattttgtcgtgctgttgcgcggttttcacttggcactgtcctttaaactccttctgtgccgtgac

SEQ ID NO: 2711 - DNA, 201 bp, Homo sapiens
ttctgttggctggctgtagaactacggagaacatctggagaaacacgtcaagggtgtgtgtgaaatcgttgagcctactcgattttgtcgtgctgttgcgyggttttcacttggcactgtcctttaaactccttctgtgccgtgactctgcagtgtctggcagcgtagtagactctactccctctatggacgtgatccctc

SEQ ID NO: 2712 - DNA, 201 bp, Homo sapiens
attcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacag

SEQ ID NO: 2713 - DNA, 201 bp, Homo sapiens
gcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtgga

SEQ ID NO: 2714 - DNA, 201 bp, Homo sapiens
tatttttaattttttgaggaaccactgtactgttttccatgtagactgcataagaattccaatttttccacatcttgccaacgtttatttttatttatttytttaaattttttatagtagctatccattctaatggatgtgaggtggtatctcattatggttttgatgggacttttgagttttagcaaatatcaatgaagt

SEQ ID NO: 2715 - DNA, 201 bp, Homo sapiens
cacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaa

SEQ ID NO: 2716 - DNA, 201 bp, Homo sapiens
cttactatatttttattgtaccttttctatgtttaggtatgtttaaatacacacatacttaccatggtgttacaactgcctgcagtattcagtgcagtaaygcactacaggtttgcaggttggtagcctaggagtaataggctatactgtatagcctaggtgtgtagtaggctataccattgaggtgtaagtatactctga

SEQ ID NO: 2717 - DNA, 201 bp, Homo sapiens
ctcctgctctttgttttctaaactttcagcggactcgattgggcgaaagccttccggctccctttactaagtcgtttaggtggtggctggggggacaaagragggtttttatctttaaaagataagtacggtttagaagacacgggagaaataatccattttgttatgttatgcagttgaactgtatagcttctctagttt

SEQ ID NO: 2718 - DNA, 201 bp, Homo sapiens
acatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaa

SEQ ID NO: 2719 - DNA, 201 bp, Homo sapiens
aagagccaggattttcaggctggccatttcaggatcagccatttcccacttcctgattcatagcttccaggatttgtaatgcctgtagacttttttctctyttgcttaaaagtggccattgaaagaaaaaataaatagcaaaatccccatcccagaagttctacttcctgttgttgtactattgagctctgaaaaacagct

SEQ ID NO: 2720 - DNA, 201 bp, Homo sapiens
cagaatgtttgaaactttgtgaggagtctgaccccacactgtaggctccctccatgtatatatttcttcttccttttcctttttttttttttttttttttwaatttttgagatagtgtctcgctctgtaaccccagttggaatgcagtggcatggtcatggcttactgcagcctcaacgtcccaggctcaagggatcctcc

SEQ ID NO: 2721 - DNA, 201 bp, Homo sapiens
catgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaac

SEQ ID NO: 2722 - DNA, 201 bp, Homo sapiens
acttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttag

SEQ ID NO: 2723 - DNA, 201 bp, Homo sapiens
cctagggttgtagaaattctcccccatgattgcacaacccactccttctcagccagtgtgcacctggagtcagctgtgtttggccttaaggtgtccatggkccagcagggagagggcagatgggtcagtgttgtcctgctagtgatgagtatcccatggtgggcatgctgatgccacgcaagggagagggtgtctggttct

SEQ ID NO: 2724 - DNA, 201 bp, Homo sapiens
aagactaattgattaatttattaagcacttattgtccagtttgcctttaattttcatttttctaagtttccattagctatcatggcctcacttgttatttmataatgaatggttacaaattgtttgtgtgtttttgtaattagaatgtaatagcaatcgtctaccagatgagctgacattgtaatgacatgaagtcagtaa

SEQ ID NO: 2725 - DNA, 201 bp, Homo sapiens
ttgagaaatcctgatgtccaagttgcacccccaccccaattcaataggagcgtttggggttaggatccaggaatcagtgcttgtctaaagatccctaggcwcttcagcaggcagcaaagattggaaaccactgctttatcccttcatttcttcccatgtgcatatcacaaagcactttgacggttttttttcctaaatatt

SEQ ID NO: 2726 - DNA, 201 bp, Homo sapiens
ccgcctgagccccccaaatagctgggaccacaagtatgcaccaccatacctggcttttttttttttttttttttttttgtattttttgtagagacggggtmattctatgttgcccaggcttgtctcgaactcctggcctcaagcgatccacctgccttggcttctcaaagtgctaggattacagatgtgagccactatgcc

SEQ ID NO: 2727 - DNA, 201 bp, Homo sapiens
ctgtcactcacggatgtactctttgccccaggtgaaagtgacgtcctgcatttcacctccaccaccacgtcgaagaatcgcatcatcataacctggcaccrgtaccggccccctgactacagggatctcatcagcttcaccgtttactacaaggaagcgtgagtttctgctttgggtgatgccattctgttgacagggcta

SEQ ID NO: 2728 - DNA, 201 bp, Homo sapiens
gcctgagccccccaaatagctgggaccacaagtatgcaccaccatacctggcttttttttttttttttttttttttgtattttttgtagagacggggtaaytctatgttgcccaggcttgtctcgaactcctggcctcaagcgatccacctgccttggcttctcaaagtgctaggattacagatgtgagccactatgcctg

SEQ ID NO: 2729 - DNA, 201 bp, Homo sapiens
gtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctc

SEQ ID NO: 2730 - DNA, 201 bp, Homo sapiens
gttttccctttcgtttttcttttctgcttttaatgagccttaattaatccagggagctaggctgcagtatctgtggctctccctgatgttttctttctgcmtttctgtcttggaggggaacctgaggatttggaagtagagggctctactagtgcttcctttttgtccttttctcattgtccaaaagagtcttaagcgatc

SEQ ID NO: 2731 - DNA, 201 bp, Homo sapiens
tggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggct

SEQ ID NO: 2732 - DNA, 201 bp, Homo sapiens
gagccactgcctttgctgccacattttgcttggttattgtgtgagaacaccatttttctctttttaaatgaattgtgtttctctttttaaattgagcatcygactgggcgcggtggctcacgcctgtaatcccagcactttgggaggccacggtgagtggatcacctgaggtcaggaatttgagaccatcctggccaacat

SEQ ID NO: 2733 - DNA, 201 bp, Homo sapiens
ggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggctt

SEQ ID NO: 2734 - DNA, 201 bp, Homo sapiens
tcccaacactttgggaggccaaggtgggtggatctcttgaggtcaggagtttgagactagcctggccaacatgggtgaaaccccgtctctactaaaaatamaaaaattagttgggggtggtggtacacgcctgtaatcccagctacttgggaggttgaggcaagagaatctcttgaacctgggaggcagaggttgcagtga

SEQ ID NO: 2735 - DNA, 201 bp, Homo sapiens
aatagttttttagttccaataatacgtttcgtgtaacccagtatatccaaaatatccattttaacatggagtcagtattaaagttacctaaatatttcactttttttttttttttgtctaatctttgaaatcccatgtgcatgtctcaaattggactggccacatggaatgctcaggagtcccatgtagggaccagctgcc

SEQ ID NO: 2736 - DNA, 201 bp, Homo sapiens
ccaccctctgttctgccaagcattggtccccagcacccctgggtgttagtgcctcttcctggttcactcactcactttctctggccctctctgtgtctctstcactctctttctttcgagatggagttttgctctgttgcccaggctggggtgcagtggcatgatctcagctcactgcaacctccaccacctgggttcaag

SEQ ID NO: 2737 - DNA, 201 bp, Homo sapiens
aaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtaccct

SEQ ID NO: 2738 - DNA, 201 bp, Homo sapiens
agaatgctttcatgatacgtcttggtacttcattacaacaaaaacaaacttattgccacccaggtcgacaggtgggaacagtgtcaccttatttgaacttratttattcggcctttgagaagcacttatagccagtttcctcgaggggcaacaaaatgacattgcagttcaaaagtgctttaaaaacttctttttcccaaa

SEQ ID NO: 2739 - DNA, 201 bp, Homo sapiens
gtatttcatttcaggtgcagatgccttcactttcccacaaaaaaaaccccaacaaaacctaagaccttactgcaactaagtctccaagtactttttaaccyaatgggatgaacagcctgtggtctgctcagatcaccctgagtgcgtgtgagaaggcctgggctttgccaggaaatccaggaaggcagggccgggctgtgt

SEQ ID NO: 2740 - DNA, 201 bp, Homo sapiens
taagcaatacaatttaaataatttttaaaggaaacatttctaaaggacgttttacattgcttgcattaaaaagaatataatgaacataatccaactttttstcaatactcagggtcatcactgtgaaagtaacttcattctatgataagataatgatgctcccaggtgggcaaggcagtttttcatctaaggtaattgaga

SEQ ID NO: 2741 - DNA, 201 bp, Homo sapiens
attgatagaacaaggcaagaccactttccccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgt

SEQ ID NO: 2742 - DNA, 201 bp, Homo sapiens
acatatgtctatatcggggtgccagtggagtcaccctagtcatatgtaaactctatttatttggttccgaaactgaatttattttgtttgcaagtttggtrtttgggagcatttaagaaatatccatagattcttgtatgatactgacattaaatcattaaataccatattttttaaatgcctctgtctgtttgcatggat

SEQ ID NO: 2743 - DNA, 201 bp, Homo sapiens
gaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtt

SEQ ID NO: 2744 - DNA, 201 bp, Homo sapiens
gaacttgaaatgattggattattttgtaatacgtcgatactacttttagaagcttttgaataactgtgtcaaagaagctttagaagaggttttaagcaggrttgcagagaatgtactgagtgtgtttttccactcacaaggaaagacagcagctgaatgcagaagtgtgtgtctggttctaactctttatcacttcaggga

SEQ ID NO: 2745 - DNA, 201 bp, Homo sapiens
ctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctg

SEQ ID NO: 2746 - DNA, 201 bp, Homo sapiens
atgcaatgtaaaagtgatttactgtcctataattgttttcctgaaagcaaaatgatatttaagtgaactgcaatgaaaaatgcaacgactgtaatttatcrttgaagggcattttcaaagtgtatagaatgactaaagcttaagtgtattaaatattctagaggaagacatatttaggctataaatctagacttcctttgg

SEQ ID NO: 2747 - DNA, 201 bp, Homo sapiens
aaagaagctttagaagaggttttaagcaggattgcagagaatgtactgagtgtgtttttccactcacaaggaaagacagcagctgaatgcagaagtgtgtrtctggttctaactctttatcacttcagggactgtccaggcagcaccatccgttgggtctcctgcccttcctcctcccacccctgccttacccctggccat

SEQ ID NO: 2748 - DNA, 201 bp, Homo sapiens
tttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctca

SEQ ID NO: 2749 - DNA, 201 bp, Homo sapiens; identical to SEQ ID NO: 249

SEQ ID NO: 2750 - DNA, 201 bp, Homo sapiens
tttccactcacaaggaaagacagcagctgaatgcagaagtgtgtgtctggttctaactctttatcacttcagggactgtccaggcagcaccatccgttggrtctcctgcccttcctcctcccacccctgccttacccctggccattcttttgtgaccagtagtcctttatgaatggaattctgagaatgtataattttctc

SEQ ID NO: 2751 - DNA, 201 bp, Homo sapiens
agacagcagctgaatgcagaagtgtgtgtctggttctaactctttatcacttcagggactgtccaggcagcaccatccgttgggtctcctgcccttcctcytcccacccctgccttacccctggccattcttttgtgaccagtagtcctttatgaatggaattctgagaatgtataattttctcagaagaatgcttcttta

SEQ ID NO: 2752 - DNA, 201 bp, Homo sapiens
agaagtgtgtgtctggttctaactctttatcacttcagggactgtccaggcagcaccatccgttgggtctcctgcccttcctcctcccacccctgccttayccctggccattcttttgtgaccagtagtcctttatgaatggaattctgagaatgtataattttctcagaagaatgcttctttagctcaccaaatatttct

SEQ ID NO: 2753 - DNA, 201 bp, Homo sapiens
cacttcagggactgtccaggcagcaccatccgttgggtctcctgcccttcctcctcccacccctgccttacccctggccattcttttgtgaccagtagtcstttatgaatggaattctgagaatgtataattttctcagaagaatgcttctttagctcaccaaatatttcttgtttgctgaggggggaaaaagatcctcct

SEQ ID NO: 2754 - DNA, 201 bp, Homo sapiens
ctcagaagaatgcttctttagctcaccaaatatttcttgtttgctgaggggggaaaaagatcctccttggaaaagtcactgggtgccaaaggtgggtgatkaggagagatgaacttctgggtgtgcctagcaaagctgtttctgttgataggcgattaacaaaacagccaaacttgacctaacagactgccattttgagag

SEQ ID NO: 2755 - DNA, 201 bp, Homo sapiens
gtttgaggcagactccaaccacatttccatccagtggcttagtggtcttacccgtgagcttgaactgttgtccctgccaggacagtctttgcctctgtaartatctccatattcctccatcctttcaggtcccattcagtccctaggtcctccatgatggaatattggttgatgcacttattccacaaacatttgttggcc

SEQ ID NO: 2756 - DNA, 201 bp, Homo sapiens
tatagctcagttgtatgtagtattttctgtgtggtgttatgccctctgtatctgttttctcagatgttttagttgcttttctctcttaatcttgattagayctgccagagctgtgcttattttgtgtccccatccaaatccagaattaattgccgtgctccacatgttttggtcaatggtggacctcatctgtaacagtag

SEQ ID NO: 2757 - DNA, 201 bp, Homo sapiens
aaaaagatcctccttggaaaagtcactgggtgccaaaggtgggtgatgaggagagatgaacttctgggtgtgcctagcaaagctgtttctgttgataggcrattaacaaaacagccaaacttgacctaacagactgccattttgagaggaatttgttttgcaggattaattggcttcgaggtgtactggtggctgtgcagt

SEQ ID NO: 2758 - DNA, 201 bp, Homo sapiens
catcctttcaggtcccattcagtccctaggtcctccatgatggaatattggttgatgcacttattccacaaacatttgttggccacctttcaagtgccagwcaacccttctaggtatggaggggtacagtgatgagcaagccactgtttctggctgcagagggctcactgtttagtgggagaaacagacaaatcatacatc

SEQ ID NO: 2759 - DNA, 201 bp, Homo sapiens
aaaaggggcttctacactgttggcctctcgaggagaacggtttttgtttctgtcttcctggaaaagaggtgactgctggcatcatctttctagataaactscttgctatgatgccattagaagcagtgttcttttgtgttttgcttttgtttttccctgtagacaggaataacattttgactagaaacttccctgatgtaa

SEQ ID NO: 2760 - DNA, 201 bp, Homo sapiens
gcctttgtttttattgttggtcactgtaagaattccaaggaatagaaggatctcatgggcaaaatcagtttgcttttttctctgtatatttgttagtttayagcagcttctattttcctcctatttttaaaagctgaaatgcctttaatcgcactcagtgtgtttattcatggaagccagagaagagggtcccttcctttc

SEQ ID NO: 2761 - DNA, 201 bp, Homo sapiens
atttggaagtaacccctggccagcaattcactgtagtgtttgggaaacataggaatatctgcttattgtgacagattctcaagaaacctgtttcctttccrcaaagatggaaaccaggcactgtaccaatgagtcagttcactacgttttgtcctctgtccttacacgcagcggagacagacgagaacttggtcctctgcc

SEQ ID NO: 2762 - DNA, 201 bp, Homo sapiens
aaggaccgtgttttcctcaggggaatccatgggctgagaagactggggagcctcagaggccctttcccaaagccctctgctctccccttccaggttctgasctaaggaccagccagaagcctgccgagcgtcagccgaacctgcaagtggcttctgggctgttccgttccctgcgtgagctttccctctctgctgctgctg

SEQ ID NO: 2763 - DNA, 201 bp, Homo sapiens
tcggtaggacccccgtgtgccactacacaaagaaggaccgtgttttcctcaggggaatccatgggctgagaagactggggagcctcagaggccctttcccraagccctctgctctccccttccaggttctgacctaaggaccagccagaagcctgccgagcgtcagccgaacctgcaagtggcttctgggctgttccgttc

SEQ ID NO: 2764 - DNA, 201 bp, Homo sapiens
gagaaccacctgggtagaggtttccaaaattgtctgattgtaaaaatcacctgaggagcttggtaaagcttgactgtcccaggcctcatttgaggctactragtcaatgtccaggctggggcttggacaagaatgtcattctttttgggtcaaagccaggttaggtgataccgccttgccagataaatggccgggactagg

SEQ ID NO: 2765 - DNA, 201 bp, Homo sapiens
gagctgcggtgagagagaccatgaaaagaagggccagagcggtgtcctgcagagggtggtgtaccttgggagggaagtgtgtagggttgttgaggaacagygtgctgcacagggaggaaagacgtggggcagcattgtgggaagagcaaccaagattctcataggcttgggagcggaagccctgaggtctgttgctggact

SEQ ID NO: 2766 - DNA, 201 bp, Homo sapiens
gtgctttagggtggggggacttgagacccttgacttgactcggtcccactggaaagcttctgttgcttatttgggtaaccccaactctatcttattgggcrgtagtgttatcctaattcttggaaatactcagtgtagaataaagagctgatgaaaatgtgtaagaagggagtaagtggtcattagagagaaatggtaatt

SEQ ID NO: 2767 - DNA, 201 bp, Homo sapiens
ctgtaatcccagcactttgggaggccacggtgagtggatcacctgaggtcaggaatttgagaccatcctggccaacatggtgaaactcctgtctctacttaaaaaaaaaaaaaatgcaaaaactagctgggcatggtggtgcacatctgtaatcccagccacttgggaggctgagggcaggagaatggcttgaacctggga

SEQ ID NO: 2768 - DNA, 201 bp, Homo sapiens
ttttaaaagggttccattttcccctcatatgactttggttcattctcctccttgtttctgtctctcagtgaactttccaaaagatgggttatgatgaaagrtgaatcgtcgttgataactgctcttacttatctgtgtatcgaaactgcaggtagtgctcttcagctctgtggctggatttagtgcctcttctagggaggg

SEQ ID NO: 2769 - DNA, 201 bp, Homo sapiens
ttgggaggccacggtgagtggatcacctgaggtcaggaatttgagaccatcctggccaacatggtgaaactcctgtctctacttaaaaaaaaaaaaaatgsaaaaactagctgggcatggtggtgcacatctgtaatcccagccacttgggaggctgagggcaggagaatggcttgaacctgggatgcggaggtcatagtg

SEQ ID NO: 2770 - DNA, 201 bp, Homo sapiens
tctcatttttatgctgttcagagtgtggttgaagttcagccatcactagtccttcacggatagttcataccccaagttgatggccttgtggaattgctgaygctattttcatatatatatatatataattctagcctttttctctggtcttataagagtcacatacgtaggtaatttcatatcctacaaatatgttctaaa

SEQ ID NO: 2771 - DNA, 201 bp, Homo sapiens
taaaaaaaaaaaaaatgcaaaaactagctgggcatggtggtgcacatctgtaatcccagccacttgggaggctgagggcaggagaatggcttgaacctggsatgcggaggtcatagtgagccaagactgtgtcattgcactccagcctgagcaacagagagagactgcctcaaaaaaaaaaaaatccgtttacatagtgat

SEQ ID NO: 2772 - DNA, 201 bp, Homo sapiens
gtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatc

SEQ ID NO: 2773 - DNA, 201 bp, Homo sapiens
tgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggca

SEQ ID NO: 2774 - DNA, 201 bp, Homo sapiens
agcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaa

SEQ ID NO: 2775 - DNA, 201 bp, Homo sapiens
aggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttct

SEQ ID NO: 2776 - DNA, 201 bp, Homo sapiens
ggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttctt

SEQ ID NO: 2777 - DNA, 201 bp, Homo sapiens
gttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttg

SEQ ID NO: 2778 - DNA, 201 bp, Homo sapiens
caccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccag

SEQ ID NO: 2779 - DNA, 201 bp, Homo sapiens
ccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagcc

SEQ ID NO: 2780 - DNA, 201 bp, Homo sapiens
tgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccatt

SEQ ID NO: 2781 - DNA, 201 bp, Homo sapiens
tcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaa

SEQ ID NO: 2782 - DNA, 201 bp, Homo sapiens
ttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagccaaaatgcagcacagggaga

SEQ ID NO: 2783 - DNA, 201 bp, Homo sapiens
aggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtt

SEQ ID NO: 2784 - DNA, 201 bp, Homo sapiens
aagtccctgggcaagtagccagcgtaactgattgacctaaaacaaaggatggagcccttggggctctgcatagtgaaatgtatgatttcttagtggaaaaygagaaagccactgaggaagcccagaagggaacttagcatatacagccagctttggggaagggggaagcagtgccaagcaagacaggtgcttttcagagac

SEQ ID NO: 2785 - DNA, 201 bp, Homo sapiens
atcctccttggaaaagtcactgggtgccaaaggtgggtgatgaggagagatgaacttctgggtgtgcctagcaaagctgtttctgttgataggcgattaayaaaacagccaaacttgacctaacagactgccattttgagaggaatttgttttgcaggattaattggcttcgaggtgtactggtggctgtgcagtgatgac

SEQ ID NO: 2786 - DNA, 201 bp, Homo sapiens
ttagagagaaatggtaattgggatgatgctctgaccccttcagcaaaaaataaaaggtgaatggtttattatgagctagttcagattctgtttttggaaaygagcttggttatacatagtgcatttgaaaagcgtgaagcatggactttcagatgccagctcctcagcctcctgtaactccagtcgcaaaatccctccagt

SEQ ID NO: 2787 - DNA, 201 bp, Homo sapiens
gtgtgcttggtacgaagtagtaacatcaattcagtgttcagtacatccactttgttccagaacaatgtattcaaggtcggtgtattttggctgtgccacakagttctggaaattcccaagagaataagttttcacctgttatataatccagcacaagtgactgtgtagcagcaacctcatgtttcatgatgactttaaaat

SEQ ID NO: 2788 - DNA, 201 bp, Homo sapiens
tgtgaagcgaggacttggggtcccaagtctaggttttaggttccctgctgtaacccgtggccaccgagagagagttttatgataaaatgtcagcaaagtayctgacaacgtctcacgctagaatgagtttcgtacatgtttagttccctctctttttattccacgctcccccaccccaactttaaatcagaaacgtgaggg

SEQ ID NO: 2789 - DNA, 201 bp, Homo sapiens
cccgtggccaccgagagagagttttatgataaaatgtcagcaaagtacctgacaacgtctcacgctagaatgagtttcgtacatgtttagttccctctctytttattccacgctcccccaccccaactttaaatcagaaacgtgagggtgctgattgaagctttttataacttttcttattgagaattgttctctggagtt

SEQ ID NO: 2790 - DNA, 201 bp, Homo sapiens
agagagagttttatgataaaatgtcagcaaagtacctgacaacgtctcacgctagaatgagtttcgtacatgtttagttccctctctttttattccacgcycccccaccccaactttaaatcagaaacgtgagggtgctgattgaagctttttataacttttcttattgagaattgttctctggagttgtctccaagaaca

SEQ ID NO: 2791 - DNA, 201 bp, Homo sapiens
ctccttctctccttgtctcttctgtcctccagtcaaagaaaaactctgcatatgatctttggcctggagaaatattaaatctatgttaagtatgcagacaygaatgggcaaatgaaggatttgtggcaaagaagatctgccgaaacaaataagtcatgtaaatgggcagagggaaatattaaattgattgcatctttcagc

SEQ ID NO: 2792 - DNA, 201 bp, Homo sapiens
tgcctggaagatgcggagcggagtttgcgtggcccggagcagctccagtgtctgaggcttctctgtgtcacaggctccaagcaggaagcgcaggcaaaatrgcaaaatacagcatgtggcattcagttcaaaaatgcccttttttagaagtcggtattctaaatgacatccagtcttgcttagttttttaagagaaaggaa

SEQ ID NO: 2793 - DNA, 201 bp, Homo sapiens
ccttgtctcttctgtcctccagtcaaagaaaaactctgcatatgatctttggcctggagaaatattaaatctatgttaagtatgcagacatgaatgggcaratgaaggatttgtggcaaagaagatctgccgaaacaaataagtcatgtaaatgggcagagggaaatattaaattgattgcatctttcagctcctggtact

SEQ ID NO: 2794 - DNA, 201 bp, Homo sapiens
attaaatctatgttaagtatgcagacatgaatgggcaaatgaaggatttgtggcaaagaagatctgccgaaacaaataagtcatgtaaatgggcagagggmaatattaaattgattgcatctttcagctcctggtacttaatgcaaagataaagtagtgggaaaaggttgtcatttgaaataatggaaagatgagggagtt

SEQ ID NO: 2795 - DNA, 201 bp, Homo sapiens
gatactggatactagctcattaaactcttgtgagaagccttcattagcattatgggaagacttgctgtatctatattatgaaggcatttagattttttttwaaatgcatgttcttaacattttttgtttattaagtggggcagtagattaggactgaatggatttgattctctcatcctacatagtgtgcccagaagccag

SEQ ID NO: 2796 - DNA, 201 bp, Homo sapiens
cagtagtggtggttggtgctgcgtgttgactggagttgcttgcattgggagagcctgacttggccaagtgtgtagcttgagaccagttggattcctctcasagagacagtcttcacccccaagctctgggtgttgggcgtgcagcattcgtattcagcaaacatttgctgatttccgcctctgcaactactgagctcagct

SEQ ID NO: 2797 - DNA, 201 bp, Homo sapiens
aaggcaaaactatagagacagaaagcagaccagggatggctgcaaggaagaggtggagattgaccaccaatgggaatgagggaactcttggatgatggaartgttctggaactgagtagtggtgatggttggacagttgtgtaaatttacggaagctcatggaatgatgggtgaattttttttttttttttttttgagatg

SEQ ID NO: 2798 - DNA, 201 bp, Homo sapiens
ttcttaaaactttcttcaactttggtataagaaagactctgtagcctgaaagttaattttcaaacatggctgcagaaagacttggtgtcaaaagatgtggraagtattttacacaatgaaaatcaccacaacaaccagggacctgtgggggtagagtcctttgggtttagaggcattgatgtaattttttttggcagtttt

SEQ ID NO: 2799 - DNA, 201 bp, Homo sapiens
ccaagccttttcctttgaggctcagggcgggctggctaacattgctatattgaacaacaacttgaataccttgatccagcgttccaaccacactcaggccrccaacggtacgccctatctttgcctcttcctctgtagcccaactggaagggatgagagggcctctctgccaccctcagactaggaagcctaagtgccccc

SEQ ID NO: 2800 - DNA, 201 bp, Homo sapiens
agaccaacaggggagtttatgtttgaatttgatgaagatgagatgttctatgtggatctggacaagaaggagaccgtctggcatctggaggagtttggccragccttttcctttgaggctcagggcgggctggctaacattgctatattgaacaacaacttgaataccttgatccagcgttccaaccacactcaggccacc

SEQ ID NO: 2801 - DNA, 201 bp, Homo sapiens
atgtgtcaacttatgccgcgtttgtacagacgcatagaccaacaggggagtttatgtttgaatttgatgaagatgagatgttctatgtggatctggacaaraaggagaccgtctggcatctggaggagtttggccaagccttttcctttgaggctcagggcgggctggctaacattgctatattgaacaacaacttgaata

SEQ ID NO: 2802 - DNA, 201 bp, Homo sapiens
tacaaactccatctcagcttttcttctcacttcatgtgaaaactactccagtggctgactgaattgctgacccttcaagctctgtccttatccattaccthaaagcagtcattccttagtaaagtttccaacaaatagaaattaatgacactttggtagcactaatatggagattatcctttcattgagccttttatcctc

SEQ ID NO: 2803 - DNA, 201 bp, Homo sapiens
tggccatgggctgatcccactacagcaagggcttgcatcctctcttctcaggagagagaaaggtgagcagagtgaggctggtcagtggtgtgatacccctstctgtgattcagagctgccataaaatctaaggctgaggtagaggaccaccctcccctaagaggtggagcctttgtgattcatcccagaagaggggcctaa

SEQ ID NO: 2804 - DNA, 201 bp, Homo sapiens
tatctgttttaaggtcccagaacattccacgagaggcatcttgctcaatattctttgacaggagcaggtcagcctggagccacatcagtgacctccagggkgcgctggagttaaggcctgatacccaatggcctcatttctgacccagttcaaatacatttcaccaaggcaaggattcctgtttgttctagttgccttctc

SEQ ID NO: 2805 - DNA, 201 bp, Homo sapiens
gatcccactacagcaagggcttgcatcctctcttctcaggagagagaaaggtgagcagagtgaggctggtcagtggtgtgatacccctctctgtgattcasagctgccataaaatctaaggctgaggtagaggaccaccctcccctaagaggtggagcctttgtgattcatcccagaagaggggcctaacctggtgctgtc

SEQ ID NO: 2806 - DNA, 201 bp, Homo sapiens
tccgaggagctggggccatcaagggtgagtgctcaggaggacgcaggagcgtcggggtgagtgatggggtggttcacatcaattgctgcttcagggatcasagattttaggggctcattgatctatctggtcctcatagtctatgttccctctggccctcataataataacagcaataacagccagaatttatgagactcc

SEQ ID NO: 2807 - DNA, 201 bp, Homo sapiens; identical to SEQ ID NO: 384

SEQ ID NO: 2808 - DNA, 201 bp, Homo sapiens
ggcccacagtttcagtctcatctgcctccactcggcctcagttcctcatcactgttcctgtgctcacagtcatcaattatagaccccacaacatgcgcccwgaagacagaatgttccatatcagagctgtgatcttgagagccctctccttggctttcctgctgagtctccgaggagctggggccatcaagggtgagtgct

SEQ ID NO: 2809 - DNA, 201 bp, Homo sapiens
cagtgctagaggcccacagtttcagtctcatctgcctccactcggcctcagttcctcatcactgttcctgtgctcacagtcatcaattatagaccccacarcatgcgccctgaagacagaatgttccatatcagagctgtgatcttgagagccctctccttggctttcctgctgagtctccgaggagctggggccatcaag

SEQ ID NO: 2810 - DNA, 201 bp, Homo sapiens
aaggagcctgtggagctgggccagcccaacaccctcatctgccacattgacaagttcttcccaccagtgctcaacgtcacgtggctgtgcaacggggagcyggtcactgagggtgtcgctgagagcctcttcctgcccagaacagattacagcttccacaagttccattacctgacctttgtgccctcagcagaggacttc

SEQ ID NO: 2811 - DNA, 201 bp, Homo sapiens
ctttatggtgttgctccttcttcttccccatatgtccttcctttgacctcttaccttcttcctttttatattcataagtctttattcattctctagctttsaccacttgcatattcaaactgacattttgtcgtgtttttctctactgtctttatgcagcggaccatgtgtcaacttatgccgcgtttgtacagacgcata

SEQ ID NO: 2812 - DNA, 201 bp, Homo sapiens
tgtccttcctttgacctcttaccttcttcctttttatattcataagtctttattcattctctagctttgaccacttgcatattcaaactgacattttgtcrtgtttttctctactgtctttatgcagcggaccatgtgtcaacttatgccgcgtttgtacagacgcatagaccaacaggggagtttatgtttgaatttgat

SEQ ID NO: 2813 - DNA, 201 bp, Homo sapiens
aggagcctgtggagctgggccagcccaacaccctcatctgccacattgacaagttcttcccaccagtgctcaacgtcacgtggctgtgcaacggggagctrgtcactgagggtgtcgctgagagcctcttcctgcccagaacagattacagcttccacaagttccattacctgacctttgtgccctcagcagaggacttct

SEQ ID NO: 2814 - DNA, 201 bp, Homo sapiens
ggctgtgcaacggggagctggtcactgagggtgtcgctgagagcctcttcctgcccagaacagattacagcttccacaagttccattacctgacctttgtrccctcagcagaggacttctatgactgcagggtggagcactggggcttggaccagccgctcctcaagcactggggtatgcaactgcttttctctccataat

SEQ ID NO: 2815 - DNA, 201 bp, Homo sapiens
cacttgcatattcaaactgacattttgtcgtgtttttctctactgtctttatgcagcggaccatgtgtcaacttatgccgcgtttgtacagacgcatagamcaacaggggagtttatgtttgaatttgatgaagatgagatgttctatgtggatctggacaagaaggagaccgtctggcatctggaggagtttggccaagc

SEQ ID NO: 2816 - DNA, 201 bp, Homo sapiens
ccatgatgactttgcagttctggaggaaattttgtgagcgatctcagcacagtaagatttgttgcacatcagcagcactttcagctccttgaggctgtggrccagaaacttctggaagccactgggcagcatgttttttttgttgttgttgttgctcccataagcaatgttgggcatcaagatctggcccttggaccttct

SEQ ID NO: 2817 - DNA, 201 bp, Homo sapiens
agacttggtgtcaaaagatgtggaaagtattttacacaatgaaaatcaccacaacaaccagggacctgtgggggtagagtcctttgggtttagaggcattsatgtaattttttttggcagtttttatggttttatttacacacaaaacgtggacatgaactttctactcattttcttagctgtgcaccctggtactggggt

SEQ ID NO: 2818 - DNA, 201 bp, Homo sapiens
ctccacaccatacccttgtgcgctgtcctgtggcttccttttttcaccccacatgcagtcagctgccaggcctgatgaagtcccgggggtctctctgctcycgtcctcctcactccatgctcagcccagtccaggtccccgcgctcgctcccctgacaagctccagatgggctccccccatgaatccccaacccaaagtcc

SEQ ID NO: 2819 - DNA, 201 bp, Homo sapiens
gacaaaatatctgaacagaagaggacttaggagagatctgaactccagctgccctacaaactccatctcagcttttcttctcacttcatgtgaaaactacyccagtggctgactgaattgctgacccttcaagctctgtccttatccattacctcaaagcagtcattccttagtaaagtttccaacaaatagaaattaatg

SEQ ID NO: 2820 - DNA, 201 bp, Homo sapiens
ccatctccacctccatctccacaccatacccttgtgcgctgtcctgtggcttccttttttcaccccacatgcagtcagctgccaggcctgatgaagtcccsggggtctctctgctctcgtcctcctcactccatgctcagcccagtccaggtccccgcgctcgctcccctgacaagctccagatgggctccccccatgaat

SEQ ID NO: 2821 - DNA, 201 bp, Homo sapiens
ccacctttagtctccagtgtcattgctaaggcaagatcccaggtcttgactcagatatcctgacctgcctcttctcctggtgccttgggccccagaccctraaattccaggcccagagccccccagctccttgagtccagattcctcctcctctgccatccatccgcccctgcctgttcaattgccccactctgagtgtgg

SEQ ID NO: 2822 - DNA, 201 bp, Homo sapiens
gctgccctacaaactccatctcagcttttcttctcacttcatgtgaaaactactccagtggctgactgaattgctgacccttcaagctctgtccttatccrttacctcaaagcagtcattccttagtaaagtttccaacaaatagaaattaatgacactttggtagcactaatatggagattatcctttcattgagccttt

SEQ ID NO: 2823 - DNA, 201 bp, Homo sapiens
tccccagcttcctcctcctcctcccttcatttttttcctctttctagaaaaaaggtccagggctcaatcccacatcctgatactactccctcaagtccctmaggttggtgcaccaggctccccaccccacaagttcacaggaggaagccaaagctccaaggccttcctgtcccatccttgagaaatcctcttactgcacac

SEQ ID NO: 2824 - DNA, 201 bp, Homo sapiens
gttggggatgtgtgtggagttgggggagcatgcagggaattgtggaatcagccctgcccactttacccactcccctatggctccagctctccctccagcargttttgattgaacattcattctacgcagggagctccagtaatctaccctcagtccctgtcacatggctccactgcctcatctcattccccctacaaacct

SEQ ID NO: 2825 - DNA, 201 bp, Homo sapiens
ctccccagcttcctcctcctcctcccttcatttttttcctctttctagaaaaaaggtccagggctcaatcccacatcctgatactactccctcaagtcccwcaggttggtgcaccaggctccccaccccacaagttcacaggaggaagccaaagctccaaggccttcctgtcccatccttgagaaatcctcttactgcaca

SEQ ID NO: 2826 - DNA, 201 bp, Homo sapiens
tttttcatttttcaaaaatcttcagtgttctgacaatacttatctggctacatgggaacctctagggagctgattacaagcagagatccccagacctcccyacccagggaatctgagtctgggggcactgagtctggagatctgtgcatcacagaggatctccagaagagtcttcagaggagtgaggttggggacctgcgg

SEQ ID NO: 2827 - DNA, 201 bp, Homo sapiens
cctttgaggctcagggcgggctggctaacattgctatattgaacaacaacttgaataccttgatccagcgttccaaccacactcaggccaccaacggtackccctatctttgcctcttcctctgtagcccaactggaagggatgagagggcctctctgccaccctcagactaggaagcctaagtgccccctgctgtgtgat

SEQ ID NO: 2828 - DNA, 201 bp, Homo sapiens
agggggcggacatgagcggaggcgccactctcatctaatcctctttctccctctctctctcaatattaacgattcttcccaaatcttcccacccagggctrgattttaaaataggagttttcctagtaccgagttctgtggtcctaagcgggtcgcagagcctctccaggcctgttttctcaccacgcagagagagaattt

SEQ ID NO: 2829 - DNA, 201 bp, Homo sapiens
tttgctcctttctttttataactgctcatctgctctgtattatttcctttatggtgttgctccttcttcttccccatatgtccttcctttgacctcttacyttcttcctttttatattcataagtctttattcattctctagctttgaccacttgcatattcaaactgacattttgtcgtgtttttctctactgtctttat

SEQ ID NO: 2830 - DNA, 201 bp, Homo sapiens
agctccaaggccttcctgtcccatccttgagaaatcctcttactgcacacacctcacctctctccatccctttacacccagacttcctgaaggaaaaagaygaatgaactgagacactgccctgtgacagccgtggggaacccaagacaagtaaaatccatctcagccccgaggaggatgcgccacactcagcctcatgca

SEQ ID NO: 2831 - DNA, 201 bp, Homo sapiens
aaccttctctttttcatttttcaaaaatcttcagtgttctgacaatacttatctggctacatgggaacctctagggagctgattacaagcagagatccccmgacctccccacccagggaatctgagtctgggggcactgagtctggagatctgtgcatcacagaggatctccagaagagtcttcagaggagtgaggttggg

SEQ ID NO: 2832 - DNA, 201 bp, Homo sapiens
ctttgaggctcagggcgggctggctaacattgctatattgaacaacaacttgaataccttgatccagcgttccaaccacactcaggccaccaacggtacgscctatctttgcctcttcctctgtagcccaactggaagggatgagagggcctctctgccaccctcagactaggaagcctaagtgccccctgctgtgtgatc

SEQ ID NO: 2833 - DNA, 201 bp, Homo sapiens
ctgcggggagggggcggacatgagcggaggcgccactctcatctaatcctctttctccctctctctctcaatattaacgattcttcccaaatcttcccacycagggctggattttaaaataggagttttcctagtaccgagttctgtggtcctaagcgggtcgcagagcctctccaggcctgttttctcaccacgcagaga

SEQ ID NO: 2834 - DNA, 201 bp, Homo sapiens
accatgtgtcaacttatgccgcgtttgtacagacgcatagaccaacaggggagtttatgtttgaatttgatgaagatgagatgttctatgtggatctggayaagaaggagaccgtctggcatctggaggagtttggccaagccttttcctttgaggctcagggcgggctggctaacattgctatattgaacaacaacttga

SEQ ID NO: 2835 - DNA, 201 bp, Homo sapiens
aattctctgcggggagggggcggacatgagcggaggcgccactctcatctaatcctctttctccctctctctctcaatattaacgattcttcccaaatctwcccacccagggctggattttaaaataggagttttcctagtaccgagttctgtggtcctaagcgggtcgcagagcctctccaggcctgttttctcaccacg

SEQ ID NO: 2836 - DNA, 201 bp, Homo sapiens
taaagaggaggccctaggatttgtagaatgtaaggaagggaggaaaaattcaatctgataagtgttcattgatcttctaatgggttaaaagcattcagccrcataacaacaacaacaccgataactaactgagtagttaatatggtcaggcgctattctgaggatttacatttattaactcactttattctcacacatagt

SEQ ID NO: 2837 - DNA, 201 bp, Homo sapiens; identical to SEQ ID NO: 283

SEQ ID NO: 2838 - DNA, 201 bp, Homo sapiens
ctgacattttgtcgtgtttttctctactgtctttatgcagcggaccatgtgtcaacttatgccgcgtttgtacagacgcatagaccaacaggggagtttakgtttgaatttgatgaagatgagatgttctatgtggatctggacaagaaggagaccgtctggcatctggaggagtttggccaagccttttcctttgaggct

SEQ ID NO: 2839 - DNA, 201 bp, Homo sapiens
tccaatccagaaagtctggatccaagactgtttatccactgtcctattcaccctattttgtgaaggaaaagaccaagttcaaattctccagagtccattgycaaataatggagtcagatctatatttctatacataattacaacacagtgtggtgggtgcctgtaactacttactgtctctacttggactcattccatggc

SEQ ID NO: 2840 - DNA, 201 bp, Homo sapiens
ttgctgacccttcaagctctgtccttatccattacctcaaagcagtcattccttagtaaagtttccaacaaatagaaattaatgacactttggtagcactratatggagattatcctttcattgagccttttatcctctgttctcctttgaagaacccctcactgtcaccttcccgagaataccctaagaccaataaatac

SEQ ID NO: 2841 - DNA, 201 bp, Homo sapiens
tattcaaactgacattttgtcgtgtttttctctactgtctttatgcagcggaccatgtgtcaacttatgccgcgtttgtacagacgcatagaccaacaggrgagtttatgtttgaatttgatgaagatgagatgttctatgtggatctggacaagaaggagaccgtctggcatctggaggagtttggccaagccttttcct

SEQ ID NO: 2842 - DNA, 201 bp, Homo sapiens
tagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtaacttatctttttacatc

SEQ ID NO: 2843 - DNA, 201 bp, Homo sapiens
agtctatgttccctctggccctcataataataacagcaataacagccagaatttatgagactcctgcatagtttctttccccatttacatctcacaggaaycttcaatgaagataatattccattcatttagaaattattccttttatttagaaattattttgaaaaaactgaagctcaaaaagatgaataagttttccaa

SEQ ID NO: 2844 - DNA, 201 bp, Homo sapiens
gagtctccgaggagctggggccatcaagggtgagtgctcaggaggacgcaggagcgtcggggtgagtgatggggtggttcacatcaattgctgcttcaggratcacagattttaggggctcattgatctatctggtcctcatagtctatgttccctctggccctcataataataacagcaataacagccagaatttatgag

SEQ ID NO: 2845 - DNA, 201 bp, Homo sapiens
ctttcctgctgagtctccgaggagctggggccatcaagggtgagtgctcaggaggacgcaggagcgtcggggtgagtgatggggtggttcacatcaattgytgcttcagggatcacagattttaggggctcattgatctatctggtcctcatagtctatgttccctctggccctcataataataacagcaataacagccag

SEQ ID NO: 2846 - DNA, 201 bp, Homo sapiens
cttcagacagttttatttaagatgtgtagaataaagaggaggtcaggctgggtagaaccagaagtatctattgccctgttcgcggtcacctgagttatttytaatgttatgttataataaacaccacaataggcttctcttcatagatgcaaatactttttagtattcttggtagaaattcctaatgagctcagctgtctc

SEQ ID NO: 2847 - DNA, 201 bp, Homo sapiens
caagggcaccatggagtccacctttagtctccagtgtcattgctaaggcaagatcccaggtcttgactcagatatcctgacctgcctcttctcctggtgcsttgggccccagaccctaaaattccaggcccagagccccccagctccttgagtccagattcctcctcctctgccatccatccgcccctgcctgttcaattg

SEQ ID NO: 2848 - DNA, 201 bp, Homo sapiens
ttggggatgtgtgtggagttgggggagcatgcagggaattgtggaatcagccctgcccactttacccactcccctatggctccagctctccctccagcagrttttgattgaacattcattctacgcagggagctccagtaatctaccctcagtccctgtcacatggctccactgcctcatctcattccccctacaaacctc

SEQ ID NO: 2849 - DNA, 201 bp, Homo sapiens
tttgtcgtgtttttctctactgtctttatgcagcggaccatgtgtcaacttatgccgcgtttgtacagacgcatagaccaacaggggagtttatgtttgartttgatgaagatgagatgttctatgtggatctggacaagaaggagaccgtctggcatctggaggagtttggccaagccttttcctttgaggctcagggcg

SEQ ID NO: 2850 - DNA, 201 bp, Homo sapiens
tttttctctactgtctttatgcagcggaccatgtgtcaacttatgccgcgtttgtacagacgcatagaccaacaggggagtttatgtttgaatttgatgahgatgagatgttctatgtggatctggacaagaaggagaccgtctggcatctggaggagtttggccaagccttttcctttgaggctcagggcgggctggcta

SEQ ID NO: 2851 - DNA, 201 bp, Homo sapiens
cattctacgcagggagctccagtaatctaccctcagtccctgtcacatggctccactgcctcatctcattccccctacaaacctcaacccagcctttgccygtcctccctttcactgcccagcatcacatgcccccttctgctctctgctcccccacctctgggtttccttggtggctcccaacactgtccctcatcccac

SEQ ID NO: 2852 - DNA, 201 bp, Homo sapiens
catgcccccttctgctctctgctcccccacctctgggtttccttggtggctcccaacactgtccctcatcccacatgacagctctgcctatgggatggggrcgctgcatccgtcacttcctcctgacactgttcagtgtcaccagtgctgctccagcctcctctctccccagcctcacccctctgcagttcccagggctga

SEQ ID NO: 2853 - DNA, 201 bp, Homo sapiens
atgcccccttctgctctctgctcccccacctctgggtttccttggtggctcccaacactgtccctcatcccacatgacagctctgcctatgggatgggggygctgcatccgtcacttcctcctgacactgttcagtgtcaccagtgctgctccagcctcctctctccccagcctcacccctctgcagttcccagggctgag

SEQ ID NO: 2854 - DNA, 201 bp, Homo sapiens
cagtcattccttagtaaagtttccaacaaatagaaattaatgacactttggtagcactaatatggagattatcctttcattgagccttttatcctctgttytcctttgaagaacccctcactgtcaccttcccgagaataccctaagaccaataaatacttcagtatttcagagcggggagactctgagtcattcttactg

SEQ ID NO: 2855 - DNA, 201 bp, Homo sapiens
agcagtcattccttagtaaagtttccaacaaatagaaattaatgacactttggtagcactaatatggagattatcctttcattgagccttttatcctctgktctcctttgaagaacccctcactgtcaccttcccgagaataccctaagaccaataaatacttcagtatttcagagcggggagactctgagtcattcttac

SEQ ID NO: 2856 - DNA, 201 bp, Homo sapiens
gtcattccttagtaaagtttccaacaaatagaaattaatgacactttggtagcactaatatggagattatcctttcattgagccttttatcctctgttctyctttgaagaacccctcactgtcaccttcccgagaataccctaagaccaataaatacttcagtatttcagagcggggagactctgagtcattcttactgga

SEQ ID NO: 2857 - DNA, 201 bp, Homo sapiens
cccccttctgctctctgctcccccacctctgggtttccttggtggctcccaacactgtccctcatcccacatgacagctctgcctatgggatgggggcgcygcatccgtcacttcctcctgacactgttcagtgtcaccagtgctgctccagcctcctctctccccagcctcacccctctgcagttcccagggctgagccg

SEQ ID NO: 2858 - DNA, 201 bp, Homo sapiens
ttagtaaagtttccaacaaatagaaattaatgacactttggtagcactaatatggagattatcctttcattgagccttttatcctctgttctcctttgaaraacccctcactgtcaccttcccgagaataccctaagaccaataaatacttcagtatttcagagcggggagactctgagtcattcttactggaagtctagg

SEQ ID NO: 2859 - DNA, 201 bp, Homo sapiens
ctctgctcccccacctctgggtttccttggtggctcccaacactgtccctcatcccacatgacagctctgcctatgggatgggggcgctgcatccgtcacytcctcctgacactgttcagtgtcaccagtgctgctccagcctcctctctccccagcctcacccctctgcagttcccagggctgagccgtcctgctggtta

SEQ ID NO: 2860 - DNA, 201 bp, Homo sapiens
ccttcctgtcccatccttgagaaatcctcttactgcacacacctcacctctctccatccctttacacccagacttcctgaaggaaaaagacgaatgaactsagacactgccctgtgacagccgtggggaacccaagacaagtaaaatccatctcagccccgaggaggatgcgccacactcagcctcatgcaccccctccca

SEQ ID NO: 2861 - DNA, 201 bp, Homo sapiens
agaggcattcttcgtgagcactgaatcctcagtgatcctcagagcctggacactccagcttagggctctctgcctgagtcccctccaggctggatgcagayatgaacacgcccaggagcctgcacttgccaacttctctctctgcaaaccttgtctgtccaaggttatccaggacctcttggtcccattttccccaaagac

SEQ ID NO: 2862 - DNA, 201 bp, Homo sapiens
tgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgcta

SEQ ID NO: 2863 - DNA, 201 bp, Homo sapiens
gaggcattcttcgtgagcactgaatcctcagtgatcctcagagcctggacactccagcttagggctctctgcctgagtcccctccaggctggatgcagacrtgaacacgcccaggagcctgcacttgccaacttctctctctgcaaaccttgtctgtccaaggttatccaggacctcttggtcccattttccccaaagaca

SEQ ID NO: 2864 - DNA, 201 bp, Homo sapiens
gatgagtggaccccagagccagagagtcccctgctcttcagaggtggggtctagagggtcatcagagactcactccactccacggtgacaggactatccamgctggtgtgctccacttggcaggtgtagacatctccctgctggggggtcatttccagcatcaccaggatctggaaggtccagtctccattacggatcagg

SEQ ID NO: 2865 - DNA, 201 bp, Homo sapiens
ccgtccctggaaaaggtaattctctgcggggagggggcggacatgagcggaggcgccactctcatctaatcctctttctccctctctctctcaatattaasgattcttcccaaatcttcccacccagggctggattttaaaataggagttttcctagtaccgagttctgtggtcctaagcgggtcgcagagcctctccagg

SEQ ID NO: 2866 - DNA, 201 bp, Homo sapiens
caattgctgcttcagggatcacagattttaggggctcattgatctatctggtcctcatagtctatgttccctctggccctcataataataacagcaataayagccagaatttatgagactcctgcatagtttctttccccatttacatctcacaggaatcttcaatgaagataatattccattcatttagaaattattcct

SEQ ID NO: 2867 - DNA, 201 bp, Homo sapiens
gagcctggacactccagcttagggctctctgcctgagtcccctccaggctggatgcagacatgaacacgcccaggagcctgcacttgccaacttctctctstgcaaaccttgtctgtccaaggttatccaggacctcttggtcccattttccccaaagacaagcactgaccactgggcacctctctctgtttactgtaccc

SEQ ID NO: 2868 - DNA, 201 bp, Homo sapiens
agatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattg

SEQ ID NO: 2869 - DNA, 201 bp, Homo sapiens
cacagattttaggggctcattgatctatctggtcctcatagtctatgttccctctggccctcataataataacagcaataacagccagaatttatgagackcctgcatagtttctttccccatttacatctcacaggaatcttcaatgaagataatattccattcatttagaaattattccttttatttagaaattatttt

SEQ ID NO: 2870 - DNA, 201 bp, Homo sapiens
acatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagttt

SEQ ID NO: 2871 - DNA, 201 bp, Homo sapiens
accccagctgtttcctcctgtccattcaggaaccatcggacttgaatgctgcctgggtagaaatccgtcacgtggcagacaagcaggttgtggtgctgcaygggccccttcttggagggggaaacattcaccctaggctggactaggagcgtggaagaaaaataatgaaatagaatttgagattgtccttctttccttcct

SEQ ID NO: 2872 - DNA, 201 bp, Homo sapiens
tcgctgtcgaagcgcgcgaactcctcccggttgtagatgtatctctccaggaagcgctgtgtcccattaaacgcgtagcattcctgccgtccctggaaaasgtaattctctgcggggagggggcggacatgagcggaggcgccactctcatctaatcctctttctccctctctctctcaatattaacgattcttcccaaat

SEQ ID NO: 2873 - DNA, 201 bp, Homo sapiens
cgtcgctgtcgaagcgcgcgaactcctcccggttgtagatgtatctctccaggaagcgctgtgtcccattaaacgcgtagcattcctgccgtccctggaamaggtaattctctgcggggagggggcggacatgagcggaggcgccactctcatctaatcctctttctccctctctctctcaatattaacgattcttcccaa

SEQ ID NO: 2874 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggwaaaggtaattctctgcggggagggggcggacatgagcggaggcgccactctcatctaatcctctttctccctctctctctcaatattaacgattcttccc

SEQ ID NO: 2875 - DNA, 201 bp, Homo sapiens
  misc_feature (1)...(201): n = A,T,C or G, or insertion/deletion polymorphism (see Tables 1-2)
tcccccacgtcgctgtcgaagcgcgcgaactcctcccggttgtagatgtatctctccaggaagcgctgtgtcccattaaacgcgtagcattcctgccgtcnctggaaaaggtaattctctgcggggagggggcggacatgagcggaggcgccactctcatctaatcctctttctccctctctctctcaatattaacgattc

SEQ ID NO: 2876 - DNA, 201 bp, Homo sapiens
accatggagtccacctttagtctccagtgtcattgctaaggcaagatcccaggtcttgactcagatatcctgacctgcctcttctcctggtgccttgggcsccagaccctaaaattccaggcccagagccccccagctccttgagtccagattcctcctcctctgccatccatccgcccctgcctgttcaattgccccact

SEQ ID NO: 2877 - DNA, 201 bp, Homo sapiens
gggtcatttccagcatcaccaggatctggaaggtccagtctccattacggatcaggttggtggacacgaccccagctgtttcctcctgtccattcaggaascatcggacttgaatgctgcctgggtagaaatccgtcacgtggcagacaagcaggttgtggtgctgcaagggccccttcttggagggggaaacattcaccc

SEQ ID NO: 2878 - DNA, 201 bp, Homo sapiens
ctactgtctttatgcagcggaccatgtgtcaacttatgccgcgtttgtacagacgcatagaccaacaggggagtttatgtttgaatttgatgaagatgagmtgttctatgtggatctggacaagaaggagaccgtctggcatctggaggagtttggccaagccttttcctttgaggctcagggcgggctggctaacattgc

SEQ ID NO: 2879 - DNA, 201 bp, Homo sapiens
cttagggcaggagcccccgcagcctgtctcagaatttgatcccttaaagataacgtcccctaggaattgttccctgagccagaccctccaagaatggcagytcggctcttacctggagtggccctgccctggaccacagatgtgagcagcaccatcagtaacgccgtcagagccactgtccggggggccgcagaaacctgc

SEQ ID NO: 2880 - DNA, 201 bp, Homo sapiens
agatggggtttggacatggccccagggtatagatgcagaagataagatgagtggaccccagagccagagagtcccctgctcttcagaggtggggtctagabggtcatcagagactcactccactccacggtgacaggactatccaggctggtgtgctccacttggcaggtgtagacatctccctgctggggggtcatttcc

SEQ ID NO: 2881 - DNA, 201 bp, Homo sapiens
tccagtaatctaccctcagtccctgtcacatggctccactgcctcatctcattccccctacaaacctcaacccagcctttgcctgtcctccctttcactgyccagcatcacatgcccccttctgctctctgctcccccacctctgggtttccttggtggctcccaacactgtccctcatcccacatgacagctctgcctat

SEQ ID NO: 2882 - DNA, 201 bp, Homo sapiens
tcagtccctgtcacatggctccactgcctcatctcattccccctacaaacctcaacccagcctttgcctgtcctccctttcactgcccagcatcacatgcycccttctgctctctgctcccccacctctgggtttccttggtggctcccaacactgtccctcatcccacatgacagctctgcctatgggatgggggcgctg

SEQ ID NO: 2883 - DNA, 201 bp, Homo sapiens
acttgggtttttttggtctctttcacaggcttttctgtcttggccaaatcacaactgtccagttcccaggatccggtcctttgctcttccccctgggtccyctctccctggatggtctcatgtatctcagtctcctccccggctgcagacccttctgtctacctgcccatcagaccacccatctgcccctcaagcacctca

SEQ ID NO: 2884 - DNA, 201 bp, Homo sapiens
gctaccctgaaagatgaggaggtgacatgatgtcagtaccttctaggtgtgtcctaggaggggtgtggagaggtctaggaggaagggtgtaagcaggaaargtggaagtcagtggaaaactaaggtacctactttgcagtccttcctctcagagtgttggtgtaaatttggactagaaatgtcctgagagtacaatggttg

SEQ ID NO: 2885 - DNA, 201 bp, Homo sapiens
ggtcatgggcccgcccagctcgtagttgtgtctgcacatcctgtccggcactgcccgcttctcctccaggatgtccttctggctgttccagtactccgcakcaggccgccccagctccgtcaccgcccggaactcccccacgtcgctgtcgaagcgcgcgaactcctcccggttgtagatgtatctctccaggaagcgctg

SEQ ID NO: 2886 - DNA, 201 bp, Homo sapiens
ttcctcagcctcccgaatagctgggattataggtgcctgccacttcacctggctaatttttgtattattagtagagacaaggtttctccatgttggtcagsctggttctctaggagcacttgaccaacgcctgacctcaagtgatccacccgctcggcctctcaaagggctgggattacgggcctgagccactgcatctgc

SEQ ID NO: 2887 - DNA, 201 bp, Homo sapiens
ttccatatcagagctgtgatcttgagagccctctccttggctttcctgctgagtctccgaggagctggggccatcaagggtgagtgctcaggaggacgcargagcgtcggggtgagtgatggggtggttcacatcaattgctgcttcagggatcacagattttaggggctcattgatctatctggtcctcatagtctatgt

SEQ ID NO: 2888 - DNA, 201 bp, Homo sapiens
agtaaagtttccaacaaatagaaattaatgacactttggtagcactaatatggagattatcctttcattgagccttttatcctctgttctcctttgaagarcccctcactgtcaccttcccgagaataccctaagaccaataaatacttcagtatttcagagcggggagactctgagtcattcttactggaagtctaggac

SEQ ID NO: 2889 - DNA, 201 bp, Homo sapiens
ctccacatcctctccagcacctgttgtttcctgactttttaatgatcgccattttaactggtgtgagatggtatctcaagacagtgtggcaattcctcaargatctagaactagaaataccatttgacccagccatcccattactggatatatacccaaaggattataaatcatgctgctataaagacacatgcacacata

SEQ ID NO: 2890 - DNA, 201 bp, Homo sapiens
aaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttca

SEQ ID NO: 2891 - DNA, 201 bp, Homo sapiens
gaaattaatgacactttggtagcactaatatggagattatcctttcattgagccttttatcctctgttctcctttgaagaacccctcactgtcaccttccygagaataccctaagaccaataaatacttcagtatttcagagcggggagactctgagtcattcttactggaagtctaggaccaggtcacatgtgaatacta

SEQ ID NO: 2892 - DNA, 201 bp, Homo sapiens
agttagtatgaaaggtctgaaaatataaagcctgtgatgcacttaagatgacggaggaaagacagtgatactcattttaaccagtcagataagtcatgatrtttggggagattatgcgttttctttgctctgaaggtgatctcaaatattctgctggcccatctacagggattatcatttccccaattctgccacacctca

SEQ ID NO: 2893 - DNA, 201 bp, Homo sapiens
gacactttggtagcactaatatggagattatcctttcattgagccttttatcctctgttctcctttgaagaacccctcactgtcaccttcccgagaatacyctaagaccaataaatacttcagtatttcagagcggggagactctgagtcattcttactggaagtctaggaccaggtcacatgtgaatactatttcttgaa

SEQ ID NO: 2894 - DNA, 201 bp, Homo sapiens
tgcctgagtcccctccaggctggatgcagacatgaacacgcccaggagcctgcacttgccaacttctctctctgcaaaccttgtctgtccaaggttatccwggacctcttggtcccattttccccaaagacaagcactgaccactgggcacctctctctgtttactgtacccatgtccttggagagagaataggccagtag

SEQ ID NO: 2895 - DNA, 201 bp, Homo sapiens
ctggattaagaaaatgcacacatatacaccatggaatactgtgcagccataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaag

SEQ ID NO: 2896 - DNA, 201 bp, Homo sapiens
ttttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattca

SEQ ID NO: 2897 - DNA, 201 bp, Homo sapiens
  misc_feature (1)...(201): n = A,T,C or G, or insertion/deletion polymorphism (see Tables 1-2)
ctcccccacgtcgctgtcgaagcgcgcgaactcctcccggttgtagatgtatctctccaggaagcgctgtgtcccattaaacgcgtagcattcctgccgtncctggaaaaggtaattctctgcggggagggggcggacatgagcggaggcgccactctcatctaatcctctttctccctctctctctcaatattaacgatt

SEQ ID NO: 2898 - DNA, 201 bp, Homo sapiens
gcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctcatcactgttcctgtgctcacagtcatcaattatagaccccaca

SEQ ID NO: 2899 - DNA, 201 bp, Homo sapiens
agtgaccaaaaaacatcaaagatcatctgactgtctgggatgggggtggggctcgggagaaggaacataatggaaaacatttgccgtcagaagaaggtgtracttatctttttacatctctttctctaactctgaaaatgaactgtgaactggagctctcttgaccacgctggtacctaaaattctcccatctcttcccca

SEQ ID NO: 2900 - DNA, 201 bp, Homo sapiens
ctcctccaggatgtccttctggctgttccagtactccgcagcaggccgccccagctccgtcaccgcccggaactcccccacgtcgctgtcgaagcgcgcgwactcctcccggttgtagatgtatctctccaggaagcgctgtgtcccattaaacgcgtagcattcctgccgtccctggaaaaggtaattctctgcggggag

SEQ ID NO: 2901 - DNA, 201 bp, Homo sapiens
tggtagaaattcctaatgagctcagctgtctcttcagggcttccctgcccagtctcttaacatttaaacatgtcatttaccttaaaaacataagtgcaaaycaactgataaaaaacaaccttgccttcagtctgcatcctgtcccagagacactttctttgtgtcctcacacgtggagctaagcttctgacttgtctctgg

SEQ ID NO: 2902 - DNA, 201 bp, Homo sapiens
cttctcctccaggatgtccttctggctgttccagtactccgcagcaggccgccccagctccgtcaccgcccggaactcccccacgtcgctgtcgaagcgcrcgaactcctcccggttgtagatgtatctctccaggaagcgctgtgtcccattaaacgcgtagcattcctgccgtccctggaaaaggtaattctctgcggg

SEQ ID NO: 2903 - DNA, 201 bp, Homo sapiens
gggctcttcctgggtctttgtgggtggtcacaagctttcctctctcaagacagcagggttgcatggtcttgatagccttgtgattcgggttctgagagatycaggactgcaagggaggcctagacttttgatagctgcaaggactcagccagagatggaccgtagtgaatgctcctttttcctgtagctgaaatcagggag

SEQ ID NO: 2904 - DNA, 201 bp, Homo sapiens
cagggtcatgggcccgcccagctcgtagttgtgtctgcacatcctgtccggcactgcccgcttctcctccaggatgtccttctggctgttccagtactcckcagcaggccgccccagctccgtcaccgcccggaactcccccacgtcgctgtcgaagcgcgcgaactcctcccggttgtagatgtatctctccaggaagcg

SEQ ID NO: 2905 - DNA, 201 bp, Homo sapiens
gctgggaagagaggacactgccttagggcaggagcccccgcagcctgtctcagaatttgatcccttaaagataacgtcccctaggaattgttccctgagcyagaccctccaagaatggcagttcggctcttacctggagtggccctgccctggaccacagatgtgagcagcaccatcagtaacgccgtcagagccactgtc

SEQ ID NO: 2906 - DNA, 201 bp, Homo sapiens
gctgcagggtcatgggcccgcccagctcgtagttgtgtctgcacatcctgtccggcactgcccgcttctcctccaggatgtccttctggctgttccagtastccgcagcaggccgccccagctccgtcaccgcccggaactcccccacgtcgctgtcgaagcgcgcgaactcctcccggttgtagatgtatctctccagga

SEQ ID NO: 2907 - DNA, 201 bp, Homo sapiens
caaagccctcactcacctcggcgctgcagggtcatgggcccgcccagctcgtagttgtgtctgcacatcctgtccggcactgcccgcttctcctccaggakgtccttctggctgttccagtactccgcagcaggccgccccagctccgtcaccgcccggaactcccccacgtcgctgtcgaagcgcgcgaactcctcccgg

SEQ ID NO: 2908 - DNA, 201 bp, Homo sapiens
tcagagctgtgatcttgagagccctctccttggctttcctgctgagtctccgaggagctggggccatcaagggtgagtgctcaggaggacgcaggagcgtyggggtgagtgatggggtggttcacatcaattgctgcttcagggatcacagattttaggggctcattgatctatctggtcctcatagtctatgttccctct

SEQ ID NO: 2909 - DNA, 201 bp, Homo sapiens
ccatcggacttgaatgctgcctgggtagaaatccgtcacgtggcagacaagcaggttgtggtgctgcaagggccccttcttggagggggaaacattcaccytaggctggactaggagcgtggaagaaaaataatgaaatagaatttgagattgtccttctttccttccttccttccttccttccttccttccttccttcct

SEQ ID NO: 2910 - DNA, 201 bp, Homo sapiens
caggatctggaaggtccagtctccattacggatcaggttggtggacacgaccccagctgtttcctcctgtccattcaggaaccatcggacttgaatgctgyctgggtagaaatccgtcacgtggcagacaagcaggttgtggtgctgcaagggccccttcttggagggggaaacattcaccctaggctggactaggagcgt

SEQ ID NO: 2911 - DNA, 201 bp, Homo sapiens
aggccaacccggctgctcctgcgccctgggcacgggcccgcggggctgccctgggaccgccggcccaaagccctcactcacctcggcgctgcagggtcatsggcccgcccagctcgtagttgtgtctgcacatcctgtccggcactgcccgcttctcctccaggatgtccttctggctgttccagtactccgcagcaggcc

SEQ ID NO: 2912 - DNA, 201 bp, Homo sapiens
attacggatcaggttggtggacacgaccccagctgtttcctcctgtccattcaggaaccatcggacttgaatgctgcctgggtagaaatccgtcacgtggyagacaagcaggttgtggtgctgcaagggccccttcttggagggggaaacattcaccctaggctggactaggagcgtggaagaaaaataatgaaatagaat

SEQ ID NO: 2913 - DNA, 201 bp, Homo sapiens
tactgtctttatgcagcggaccatgtgtcaacttatgccgcgtttgtacagacgcatagaccaacaggggagtttatgtttgaatttgatgaagatgagawgttctatgtggatctggacaagaaggagaccgtctggcatctggaggagtttggccaagccttttcctttgaggctcagggcgggctggctaacattgct

SEQ ID NO: 2914 - DNA, 201 bp, Homo sapiens
agctgtttcctcctgtccattcaggaaccatcggacttgaatgctgcctgggtagaaatccgtcacgtggcagacaagcaggttgtggtgctgcaagggcyccttcttggagggggaaacattcaccctaggctggactaggagcgtggaagaaaaataatgaaatagaatttgagattgtccttctttccttccttcctt

SEQ ID NO: 2915 - DNA, 201 bp, Homo sapiens
accaacaggggagtttatgtttgaatttgatgaagatgagatgttctatgtggatctggacaagaaggagaccgtctggcatctggaggagtttggccaarccttttcctttgaggctcagggcgggctggctaacattgctatattgaacaacaacttgaataccttgatccagcgttccaaccacactcaggccaccaa

SEQ ID NO: 2916 - DNA, 201 bp, Homo sapiens
tattcattctctagctttgaccacttgcatattcaaactgacattttgtcgtgtttttctctactgtctttatgcagcggaccatgtgtcaacttatgccrcgtttgtacagacgcatagaccaacaggggagtttatgtttgaatttgatgaagatgagatgttctatgtggatctggacaagaaggagaccgtctggca

SEQ ID NO: 2917 - DNA, 201 bp, Homo sapiens
tctcatctaatcctctttctccctctctctctcaatattaacgattcttcccaaatcttcccacccagggctggattttaaaataggagttttcctagtaycgagttctgtggtcctaagcgggtcgcagagcctctccaggcctgttttctcaccacgcagagagagaatttactgaaaagaatgagctcaggggcactg

SEQ ID NO: 2918 - DNA, 201 bp, Homo sapiens
tgataggtgaatcccagccatgctgattcctctccacccatttccagtgctagaggcccacagtttcagtctcatctgcctccactcggcctcagttcctyatcactgttcctgtgctcacagtcatcaattatagaccccacaacatgcgccctgaagacagaatgttccatatcagagctgtgatcttgagagccctct

SEQ ID NO: 2919 - DNA, 201 bp, Homo sapiens
cctatgtgtgaggtcagttcctaagtgtgagggtttcgagaccagtcagtgtccctagattctctgacaagggggagaactatgaatcttcaggaaccccyaagccaaggtcaggaagtctccatttccctggcttcaaactatgctcaggagctggtatagaagaaagatggggtttggacatggccccagggtatagat

SEQ ID NO: 2920 - DNA, 201 bp, Homo sapiens
ttcccacccagggctggattttaaaataggagttttcctagtaccgagttctgtggtcctaagcgggtcgcagagcctctccaggcctgttttctcaccaygcagagagagaatttactgaaaagaatgagctcaggggcactgagtgatcactagggaggggcgagcactgaggggaaggcagtcccttctgctggtggc

SEQ ID NO: 2921 - DNA, 201 bp, Homo sapiens
aatctgataagtgttcattgatcttctaatgggttaaaagcattcagccacataacaacaacaacaccgataactaactgagtagttaatatggtcaggcrctattctgaggatttacatttattaactcactttattctcacacatagtctttgaggtaggtactattattttcactatttcacatgagagatacttaca

SEQ ID NO: 2922 - DNA, 201 bp, Homo sapiens
gccattttaactggtgtgagatggtatctcaagacagtgtggcaattcctcaaagatctagaactagaaataccatttgacccagccatcccattactggrtatatacccaaaggattataaatcatgctgctataaagacacatgcacacatatgtttattgcggcactattcacaatagcaaagacttggaaccaaccc

SEQ ID NO: 2923 - DNA, 201 bp, Homo sapiens
aactagaaataccatttgacccagccatcccattactggatatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactg

SEQ ID NO: 2924 - DNA, 201 bp, Homo sapiens
ctcacacatagtctttgaggtaggtactattattttcactatttcacatgagagatacttacatctttttacatacacagagactttaagcactttgatcmagttcccacagctatgaagtagtagggctagcttccaatccagaaagtctggatccaagactgtttatccactgtcctattcaccctattttgtgaagga

SEQ ID NO: 2925 - DNA, 201 bp, Homo sapiens
tttccagtgctagaggcccacagtttcagtctcatctgcctccactcggcctcagttcctcatcactgttcctgtgctcacagtcatcaattatagacccyacaacatgcgccctgaagacagaatgttccatatcagagctgtgatcttgagagccctctccttggctttcctgctgagtctccgaggagctggggccat

SEQ ID NO: 2926 - DNA, 201 bp, Homo sapiens
caatccagaaagtctggatccaagactgtttatccactgtcctattcaccctattttgtgaaggaaaagaccaagttcaaattctccagagtccattgccwaataatggagtcagatctatatttctatacataattacaacacagtgtggtgggtgcctgtaactacttactgtctctacttggactcattccatggcaa

SEQ ID NO: 2927 - DNA, 201 bp, Homo sapiens
ggaccgccggcccaaagccctcactcacctcggcgctgcagggtcatgggcccgcccagctcgtagttgtgtctgcacatcctgtccggcactgcccgctyctcctccaggatgtccttctggctgttccagtactccgcagcaggccgccccagctccgtcaccgcccggaactcccccacgtcgctgtcgaagcgcgcg

SEQ ID NO: 2928 - DNA, 201 bp, Homo sapiens
aatctgtgagttgggaggtgagagcagaagagtcccgtagttccttctcactctgatgcatttatcattctaaacccagactttcacatacacattcatcrttttctttcatgataatagttgcttttatcctcttatctttgctaattcttacaaactaataaagactaagaaacaaaataaattaaatcctacaggtgt

SEQ ID NO: 2929 - DNA, 201 bp, Homo sapiens
aagaaacaaaataaattaaatcctacaggtgttccaaactcagcaataatttctagttggcctctaaaacaaaaatcaaaatataaatgtaagaaaagttyagaatgcttagtacctgtgtgatgaaataatctgtacactaaacccccaagtcatgagtttacctatacaacaaacctgcacatgtactcctgaacataa

SEQ ID NO: 2930 - DNA, 201 bp, Homo sapiens
ccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctct

SEQ ID NO: 2931 - DNA, 201 bp, Homo sapiens
cgggcccgcggggctgccctgggaccgccggcccaaagccctcactcacctcggcgctgcagggtcatgggcccgcccagctcgtagttgtgtctgcacaycctgtccggcactgcccgcttctcctccaggatgtccttctggctgttccagtactccgcagcaggccgccccagctccgtcaccgcccggaactccccc

SEQ ID NO: 2932 - DNA, 201 bp, Homo sapiens
gaaacaaaagtttggaacaaatgccaaaataactgtactgtacttttgaatttatatgccccaaatgaaaaatattatcaacaaagctatacattctacaktttcatgttcataaactaagacagaaactttaaaactgtcaagagccctaaaatttgaaggatattttcttcttcctctcaattttgtatttttttctac

SEQ ID NO: 2933 - DNA, 201 bp, Homo sapiens
cacgggcccgcggggctgccctgggaccgccggcccaaagccctcactcacctcggcgctgcagggtcatgggcccgcccagctcgtagttgtgtctgcayatcctgtccggcactgcccgcttctcctccaggatgtccttctggctgttccagtactccgcagcaggccgccccagctccgtcaccgcccggaactccc

SEQ ID NO: 2934 - DNA, 201 bp, Homo sapiens
tatttctatacataattacaacacagtgtggtgggtgcctgtaactacttactgtctctacttggactcattccatggcaatgttcacacaaaaaatgccyctccagagatcttacaggtttctatttatcataacactcaccatgctttatatttttatatgttttgggaattctcttagcattagacagtgaacttcca

SEQ ID NO: 2935 - DNA, 201 bp, Homo sapiens
aacactggacattatccagttttctaacttttgccaatttcatgtgcataaagaaatatgctgttttattttgcatttctttaattactaataattggggytataattaggactgattagccacttgggggttccttttctataaattgcctgttcacattcattgtccatttttgtactatgtgcttccatcattttctt

SEQ ID NO: 2936 - DNA, 201 bp, Homo sapiens
actattcacaatagcaaagacttggaaccaacccaactgtccatcagtgatagactggattaagaaaatgcacacatatacaccatggaatactgtgcagycataaaaaaggatgagttcatgtcctttgtagggacatggaggaagctggaaatcatcattcacagcaaactattgcaaggacaaaaaaccaaagaccac

SEQ ID NO: 2937 - DNA, 201 bp, Homo sapiens
tctctgcgggcctctcctcacactgcacttgggtttttttggtctctttcacaggcttttctgtcttggccaaatcacaactgtccagttcccaggatccrgtcctttgctcttccccctgggtcccctctccctggatggtctcatgtatctcagtctcctccccggctgcagacccttctgtctacctgcccatcagac

SEQ ID NO: 2938 - DNA, 201 bp, Homo sapiens
cagaacattccacgagaggcatcttgctcaatattctttgacaggagcaggtcagcctggagccacatcagtgacctccagggtgcgctggagttaaggcytgatacccaatggcctcatttctgacccagttcaaatacatttcaccaaggcaaggattcctgtttgttctagttgccttctctaatgcccagaaaacat

SEQ ID NO: 2939 - DNA, 201 bp, Homo sapiens
ttccctgcccagtctcttaacatttaaacatgtcatttaccttaaaaacataagtgcaaaccaactgataaaaaacaaccttgccttcagtctgcatcctrtcccagagacactttctttgtgtcctcacacgtggagctaagcttctgacttgtctctggtacatccctgaggatcctctcatcttggccatcaggaacc

SEQ ID NO: 2940 - DNA, 201 bp, Homo sapiens
taggggctcattgatctatctggtcctcatagtctatgttccctctggccctcataataataacagcaataacagccagaatttatgagactcctgcataktttctttccccatttacatctcacaggaatcttcaatgaagataatattccattcatttagaaattattccttttatttagaaattattttgaaaaaact

SEQ ID NO: 2941 - DNA, 201 bp, Homo sapiens
aggatttgtagaatgtaaggaagggaggaaaaattcaatctgataagtgttcattgatcttctaatgggttaaaagcattcagccacataacaacaacaayaccgataactaactgagtagttaatatggtcaggcgctattctgaggatttacatttattaactcactttattctcacacatagtctttgaggtaggtac

SEQ ID NO: 2942 - DNA, 201 bp, Homo sapiens
tatgtggatctggacaagaaggagaccgtctggcatctggaggagtttggccaagccttttcctttgaggctcagggcgggctggctaacattgctatatygaacaacaacttgaataccttgatccagcgttccaaccacactcaggccaccaacggtacgccctatctttgcctcttcctctgtagcccaactggaagg

SEQ ID NO: 2943 - DNA, 201 bp, Homo sapiens
cagagactcactccactccacggtgacaggactatccaggctggtgtgctccacttggcaggtgtagacatctccctgctggggggtcatttccagcatcwccaggatctggaaggtccagtctccattacggatcaggttggtggacacgaccccagctgtttcctcctgtccattcaggaaccatcggacttgaatgct

SEQ ID NO: 2944 - DNA, 201 bp, Homo sapiens
agaaagtctggatccaagactgtttatccactgtcctattcaccctattttgtgaaggaaaagaccaagttcaaattctccagagtccattgccaaataayggagtcagatctatatttctatacataattacaacacagtgtggtgggtgcctgtaactacttactgtctctacttggactcattccatggcaatgttca

SEQ ID NO: 2945 - DNA, 201 bp, Homo sapiens
gcattcctgccgtccctggaaaaggtaattctctgcggggagggggcggacatgagcggaggcgccactctcatctaatcctctttctccctctctctctyaatattaacgattcttcccaaatcttcccacccagggctggattttaaaataggagttttcctagtaccgagttctgtggtcctaagcgggtcgcagagc

SEQ ID NO: 2946 - DNA, 201 bp, Homo sapiens
attcattctctagctttgaccacttgcatattcaaactgacattttgtcgtgtttttctctactgtctttatgcagcggaccatgtgtcaacttatgccgygtttgtacagacgcatagaccaacaggggagtttatgtttgaatttgatgaagatgagatgttctatgtggatctggacaagaaggagaccgtctggcat

SEQ ID NO: 2947 - DNA, 201 bp, Homo sapiens
aggatgtccttctggctgttccagtactccgcagcaggccgccccagctccgtcaccgcccggaactcccccacgtcgctgtcgaagcgcgcgaactcctsccggttgtagatgtatctctccaggaagcgctgtgtcccattaaacgcgtagcattcctgccgtccctggaaaaggtaattctctgcggggagggggcgg

SEQ ID NO: 2948 - DNA, 201 bp, Homo sapiens
tcagactgtgcctctgggaaggacagacccaggtttagtgtcacctccaccagctgcatccctactcatgtcctgtctgagattctggagcctgatgcagmatatcgggatgaggacagtgcagcggaaaaagcttgctaagaggaaattcagaaagagccaccctcatatctggaacaggggtgtgacctcaacaaggtg

SEQ ID NO: 2949 - DNA, 201 bp, Homo sapiens
gtgtcattgctaaggcaagatcccaggtcttgactcagatatcctgacctgcctcttctcctggtgccttgggccccagaccctaaaattccaggcccagrgccccccagctccttgagtccagattcctcctcctctgccatccatccgcccctgcctgttcaattgccccactctgagtgtggattctcccattttcat

SEQ ID NO: 2950 - DNA, 201 bp, Homo sapiens
attgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgc

SEQ ID NO: 2951 - DNA, 201 bp, Homo sapiens
gtgctgtttggtcgcatcttgtgtatacctacgtatctgcacttatccttctgaacctgctgttgtcctgtcacttgtgtttccttctgtgacttatacgygtctgcagaacaggacgtatgtattatttttatttgggtatttagcatctaacagtgtttgacatatagtagtcttttaatacatatttttgtctgaatg

SEQ ID NO: 2952 - DNA, 201 bp, Homo sapiens
ctcttaccttcttcctttttatattcataagtctttattcattctctagctttgaccacttgcatattcaaactgacattttgtcgtgtttttctctactktctttatgcagcggaccatgtgtcaacttatgccgcgtttgtacagacgcatagaccaacaggggagtttatgtttgaatttgatgaagatgagatgttc

SEQ ID NO: 2953 - DNA, 201 bp, Homo sapiens
ggaatacttgggtatctgttttaaggtcccagaacattccacgagaggcatcttgctcaatattctttgacaggagcaggtcagcctggagccacatcagygacctccagggtgcgctggagttaaggcctgatacccaatggcctcatttctgacccagttcaaatacatttcaccaaggcaaggattcctgtttgttct

SEQ ID NO: 2954 - DNA, 201 bp, Homo sapiens
tgtgatctccccagcttcctcctcctcctcccttcatttttttcctctttctagaaaaaaggtccagggctcaatcccacatcctgatactactccctcargtccctcaggttggtgcaccaggctccccaccccacaagttcacaggaggaagccaaagctccaaggccttcctgtcccatccttgagaaatcctcttac

SEQ ID NO: 2955 - DNA, 201 bp, Homo sapiens
ctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatg

SEQ ID NO: 2956 - DNA, 201 bp, Homo sapiens
ctgaagacagaatgttccatatcagagctgtgatcttgagagccctctccttggctttcctgctgagtctccgaggagctggggccatcaagggtgagtgstcaggaggacgcaggagcgtcggggtgagtgatggggtggttcacatcaattgctgcttcagggatcacagattttaggggctcattgatctatctggtc

SEQ ID NO: 2957 - DNA, 201 bp, Homo sapiens
cttcttcttccccatatgtccttcctttgacctcttaccttcttcctttttatattcataagtctttattcattctctagctttgaccacttgcatattcraactgacattttgtcgtgtttttctctactgtctttatgcagcggaccatgtgtcaacttatgccgcgtttgtacagacgcatagaccaacaggggagtt

SEQ ID NO: 2958 - DNA, 201 bp, Homo sapiens
  misc_feature (1)...(201): n = A,T,C or G, or insertion/deletion polymorphism (see Tables 1-2)
tccagtctccattacggatcaggttggtggacacgaccccagctgtttcctcctgtccattcaggaaccatcggacttgaatgctgcctgggtagaaatcngtcacgtggcagacaagcaggttgtggtgctgcaagggccccttcttggagggggaaacattcaccctaggctggactaggagcgtggaagaaaaataat

SEQ ID NO: 2959 - DNA, 201 bp, Homo sapiens
tgctcttcagaggtggggtctagagggtcatcagagactcactccactccacggtgacaggactatccaggctggtgtgctccacttggcaggtgtagacytctccctgctggggggtcatttccagcatcaccaggatctggaaggtccagtctccattacggatcaggttggtggacacgaccccagctgtttcctcct

SEQ ID NO: 2960 - DNA, 201 bp, Homo sapiens
atgaagcatgtgggatggcctcacagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccggg

SEQ ID NO: 2961 - DNA, 201 bp, Homo sapiens
gagtcccctgctcttcagaggtggggtctagagggtcatcagagactcactccactccacggtgacaggactatccaggctggtgtgctccacttggcagytgtagacatctccctgctggggggtcatttccagcatcaccaggatctggaaggtccagtctccattacggatcaggttggtggacacgaccccagctgt

SEQ ID NO: 2962 - DNA, 201 bp, Homo sapiens
gataagatgagtggaccccagagccagagagtcccctgctcttcagaggtggggtctagagggtcatcagagactcactccactccacggtgacaggactytccaggctggtgtgctccacttggcaggtgtagacatctccctgctggggggtcatttccagcatcaccaggatctggaaggtccagtctccattacgga

SEQ ID NO: 2963 - DNA, 201 bp, Homo sapiens
cctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatctgaactccagctgccctacaaactccatctcagcttttcttctcacttca

SEQ ID NO: 2964 - DNA, 201 bp, Homo sapiens
tcctccaggatgtccttctggctgttccagtactccgcagcaggccgccccagctccgtcaccgcccggaactcccccacgtcgctgtcgaagcgcgcgarctcctcccggttgtagatgtatctctccaggaagcgctgtgtcccattaaacgcgtagcattcctgccgtccctggaaaaggtaattctctgcggggagg

SEQ ID NO: 2965 - DNA, 201 bp, Homo sapiens
gaacataatggaaaacatttgccgtcagaagaaggtgtaacttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgata

SEQ ID NO: 2966 - DNA, 201 bp, Homo sapiens
gaatgagctcaggggcactgagtgatcactagggaggggcgagcactgaggggaaggcagtcccttctgctggtggctggaggaggcggagacgtttcacktggggtcactgggagaaaaaacaggggcgggaggagctggggacgtggagggcggagctgctccccctacttaactccctgactgacatttccatcctga

SEQ ID NO: 2967 - DNA, 201 bp, Homo sapiens
ggaagccctcccttccttctttctcttttccatagctaagcgctctctcttctcgaccagtttcttgagaattcctcaacttgctcctgttgttttgcatktaggagatgtagaaatatatttcttaaaactttcttcaactttggtataagaaagactctgtagcctgaaagttaattttcaaacatggctgcagaaaga

SEQ ID NO: 2968 - DNA, 201 bp, Homo sapiens
cctcccttccttctttctcttttccatagctaagcgctctctcttctcgaccagtttcttgagaattcctcaacttgctcctgttgttttgcatgtaggaratgtagaaatatatttcttaaaactttcttcaactttggtataagaaagactctgtagcctgaaagttaattttcaaacatggctgcagaaagacttggt

SEQ ID NO: 2969 - DNA, 201 bp, Homo sapiens
ctttgaccacttgcatattcaaactgacattttgtcgtgtttttctctactgtctttatgcagcggaccatgtgtcaacttatgccgcgtttgtacagacscatagaccaacaggggagtttatgtttgaatttgatgaagatgagatgttctatgtggatctggacaagaaggagaccgtctggcatctggaggagtttg

SEQ ID NO: 2970 - DNA, 201 bp, Homo sapiens
caaaaaatgcccctccagagatcttacaggtttctatttatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattata

SEQ ID NO: 2971 - DNA, 201 bp, Homo sapiens
ttgtgaaggaaaagaccaagttcaaattctccagagtccattgccaaataatggagtcagatctatatttctatacataattacaacacagtgtggtgggwgcctgtaactacttactgtctctacttggactcattccatggcaatgttcacacaaaaaatgcccctccagagatcttacaggtttctatttatcataac

SEQ ID NO: 2972 - DNA, 201 bp, Homo sapiens
cctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgt

SEQ ID NO: 2973 - DNA, 201 bp, Homo sapiens
aaggttacacagcagatcaacgagccaagtttgaagtccagacccagctctgagggtcatacactgccttccccagattcctgcacacagtgacctactaycagggccctcctatctctctgggatccccagcctctatcttttgtggctgctttacaggaactccgagctatggactctgcattaggagacgaagtgcaa

SEQ ID NO: 2974 - DNA, 201 bp, Homo sapiens
cttcttccccatatgtccttcctttgacctcttaccttcttcctttttatattcataagtctttattcattctctagctttgaccacttgcatattcaaaytgacattttgtcgtgtttttctctactgtctttatgcagcggaccatgtgtcaacttatgccgcgtttgtacagacgcatagaccaacaggggagtttat

SEQ ID NO: 2975 - DNA, 201 bp, Homo sapiens
tcaggaaccatcggacttgaatgctgcctgggtagaaatccgtcacgtggcagacaagcaggttgtggtgctgcaagggccccttcttggagggggaaacrttcaccctaggctggactaggagcgtggaagaaaaataatgaaatagaatttgagattgtccttctttccttccttccttccttccttccttccttcctt

SEQ ID NO: 2976 - DNA, 201 bp, Homo sapiens
gctggtcactgagggtgtcgctgagagcctcttcctgcccagaacagattacagcttccacaagttccattacctgacctttgtgccctcagcagaggacktctatgactgcagggtggagcactggggcttggaccagccgctcctcaagcactggggtatgcaactgcttttctctccataatctcctggcatcctcta

SEQ ID NO: 2977 - DNA, 201 bp, Homo sapiens
ttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatac

SEQ ID NO: 2978 - DNA, 201 bp, Homo sapiens
ttgagaaatcctcttactgcacacacctcacctctctccatccctttacacccagacttcctgaaggaaaaagacgaatgaactgagacactgccctgtgmcagccgtggggaacccaagacaagtaaaatccatctcagccccgaggaggatgcgccacactcagcctcatgcaccccctcccattccagctcctgccgc

SEQ ID NO: 2979 - DNA, 201 bp, Homo sapiens
aagtcactggcaccgctgtccactgtgctgctgaggtcacctcccctcagcttccaagactcttctctgcgggcctctcctcacactgcacttgggttttwttggtctctttcacaggcttttctgtcttggccaaatcacaactgtccagttcccaggatccggtcctttgctcttccccctgggtcccctctccctgga

SEQ ID NO: 2980 - DNA, 201 bp, Homo sapiens
aggcttttctgtcttggccaaatcacaactgtccagttcccaggatccggtcctttgctcttccccctgggtcccctctccctggatggtctcatgtatcycagtctcctccccggctgcagacccttctgtctacctgcccatcagaccacccatctgcccctcaagcacctcaaacccagctacctccctgtaggtttc

SEQ ID NO: 2981 - DNA, 201 bp, Homo sapiens
tgacccttcaagctctgtccttatccattacctcaaagcagtcattccttagtaaagtttccaacaaatagaaattaatgacactttggtagcactaatayggagattatcctttcattgagccttttatcctctgttctcctttgaagaacccctcactgtcaccttcccgagaataccctaagaccaataaatacttca

SEQ ID NO: 2982 - DNA, 201 bp, Homo sapiens
gtgagggtttcgagaccagtcagtgtccctagattctctgacaagggggagaactatgaatcttcaggaacccctaagccaaggtcaggaagtctccattkccctggcttcaaactatgctcaggagctggtatagaagaaagatggggtttggacatggccccagggtatagatgcagaagataagatgagtggacccca

SEQ ID NO: 2983 - DNA, 201 bp, Homo sapiens
aattctcattccagggttaagcttcttctctgccctcagtaatgtggcccttccccttgtctgtatattttggagacatgaagcatgtgggatggcctcamagtcagctggggtttgagggtgaaattcaatgactttcgtgaactccttggctcctatgtgctcttcacctggaggaccagggcatgtgcagggatgacc

SEQ ID NO: 2984 - DNA, 201 bp, Homo sapiens
tttcaaagagcagtatacacaatgtgagcaagtatccttcgttcattgccgtcattgatatggtttggatatttgtcccttccaattctcattccagggtyaagcttcttctctgccctcagtaatgtggcccttccccttgtctgtatattttggagacatgaagcatgtgggatggcctcacagtcagctggggtttga

SEQ ID NO: 2985 - DNA, 201 bp, Homo sapiens
tcctttcaaagagcagtatacacaatgtgagcaagtatccttcgttcattgccgtcattgatatggtttggatatttgtcccttccaattctcattccagsgttaagcttcttctctgccctcagtaatgtggcccttccccttgtctgtatattttggagacatgaagcatgtgggatggcctcacagtcagctggggtt

SEQ ID NO: 2986 - DNA, 201 bp, Homo sapiens
tctttgtgtttgatggggatcatgttttatttttctttatataatgggccagtgtgttcccacaactactaaatagttcaccttttccccataggttagtrgtgtctcctttgctatactgaaagctcccattataggtgggcctgtgtctgagttccatcttgttccactgttctgtttgtctcttcttgtgccagtgtc

SEQ ID NO: 2987 - DNA, 201 bp, Homo sapiens
ttgttctttgctcctttctttttataactgctcatctgctctgtattatttcctttatggtgttgctccttcttcttccccatatgtccttcctttgaccycttaccttcttcctttttatattcataagtctttattcattctctagctttgaccacttgcatattcaaactgacattttgtcgtgtttttctctactgt

SEQ ID NO: 2988 - DNA, 201 bp, Homo sapiens
cccggctgctcctgcgccctgggcacgggcccgcggggctgccctgggaccgccggcccaaagccctcactcacctcggcgctgcagggtcatgggcccghccagctcgtagttgtgtctgcacatcctgtccggcactgcccgcttctcctccaggatgtccttctggctgttccagtactccgcagcaggccgccccag

SEQ ID NO: 2989 - DNA, 201 bp, Homo sapiens
acatcctgtccggcactgcccgcttctcctccaggatgtccttctggctgttccagtactccgcagcaggccgccccagctccgtcaccgcccggaactcycccacgtcgctgtcgaagcgcgcgaactcctcccggttgtagatgtatctctccaggaagcgctgtgtcccattaaacgcgtagcattcctgccgtccct

SEQ ID NO: 2990 - DNA, 201 bp, Homo sapiens
gggaccgccggcccaaagccctcactcacctcggcgctgcagggtcatgggcccgcccagctcgtagttgtgtctgcacatcctgtccggcactgcccgcytctcctccaggatgtccttctggctgttccagtactccgcagcaggccgccccagctccgtcaccgcccggaactcccccacgtcgctgtcgaagcgcgc

SEQ ID NO: 2991 - DNA, 201 bp, Homo sapiens
caacccggctgctcctgcgccctgggcacgggcccgcggggctgccctgggaccgccggcccaaagccctcactcacctcggcgctgcagggtcatgggcycgcccagctcgtagttgtgtctgcacatcctgtccggcactgcccgcttctcctccaggatgtccttctggctgttccagtactccgcagcaggccgccc

SEQ ID NO: 2992 - DNA, 201 bp, Homo sapiens
tgccttgggccccagaccctaaaattccaggcccagagccccccagctccttgagtccagattcctcctcctctgccatccatccgcccctgcctgttcarttgccccactctgagtgtggattctcccattttcatttgttagtctttgtttctcctcctcaatcaccagtaagagaacgtttttcattcaagaataaga

SEQ ID NO: 2993 - DNA, 201 bp, Homo sapiens
tatgaaaggtctgaaaatataaagcctgtgatgcacttaagatgacggaggaaagacagtgatactcattttaaccagtcagataagtcatgatgtttggsgagattatgcgttttctttgctctgaaggtgatctcaaatattctgctggcccatctacagggattatcatttccccaattctgccacacctcacacacc

SEQ ID NO: 2994 - DNA, 201 bp, Homo sapiens
caacaccctcatctgccacattgacaagttcttcccaccagtgctcaacgtcacgtggctgtgcaacggggagctggtcactgagggtgtcgctgagagcytcttcctgcccagaacagattacagcttccacaagttccattacctgacctttgtgccctcagcagaggacttctatgactgcagggtggagcactgggg

SEQ ID NO: 2995 - DNA, 201 bp, Homo sapiens
atagatgcaaatactttttagtattcttggtagaaattcctaatgagctcagctgtctcttcagggcttccctgcccagtctcttaacatttaaacatgtmatttaccttaaaaacataagtgcaaaccaactgataaaaaacaaccttgccttcagtctgcatcctgtcccagagacactttctttgtgtcctcacacgt

SEQ ID NO: 2996 - DNA, 201 bp, Homo sapiens
tcccaaggagcctgtggagctgggccagcccaacaccctcatctgccacattgacaagttcttcccaccagtgctcaacgtcacgtggctgtgcaacgggragctggtcactgagggtgtcgctgagagcctcttcctgcccagaacagattacagcttccacaagttccattacctgacctttgtgccctcagcagagga

SEQ ID NO: 2997 - DNA, 201 bp, Homo sapiens
ccagtgctgctccagcctcctctctccccagcctcacccctctgcagttcccagggctgagccgtcctgctggttagttctcagcacccttctgtgactayaagttcaagttctcctccccttcctggacaatgaacccaaggtaatagataagaggttttagggcttgaggggctgtattcaggagattccaaccttgct

SEQ ID NO: 2998 - DNA, 201 bp, Homo sapiens
aggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaaagtggaagtcagtggaaaactaaggtacctactttgcagtcct

SEQ ID NO: 2999 - DNA, 201 bp, Homo sapiens
ccaggaatgacaataactgtgtgtgttgctgcaggtgacaaaatatctgaacagaagaggacttaggagagatctgaactccagctgccctacaaactccrtctcagcttttcttctcacttcatgtgaaaactactccagtggctgactgaattgctgacccttcaagctctgtccttatccattacctcaaagcagtca

SEQ ID NO: 3000 - DNA, 201 bp, Homo sapiens
tatgaagtagtagggctagcttccaatccagaaagtctggatccaagactgtttatccactgtcctattcaccctattttgtgaaggaaaagaccaagttsaaattctccagagtccattgccaaataatggagtcagatctatatttctatacataattacaacacagtgtggtgggtgcctgtaactacttactgtctc

SEQ ID NO: 3001 - DNA, 201 bp, Homo sapiens
aataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagaga

SEQ ID NO: 3002 - DNA, 201 bp, Homo sapiens
cagccacataacaacaacaacaccgataactaactgagtagttaatatggtcaggcgctattctgaggatttacatttattaactcactttattctcacamatagtctttgaggtaggtactattattttcactatttcacatgagagatacttacatctttttacatacacagagactttaagcactttgatcaagttcc

SEQ ID NO: 3003 - DNA, 201 bp, Homo sapiens
acctggtgctgtctccttccagatccccctgaggtgaccgtgtttcccaaggagcctgtggagctgggccagcccaacaccctcatctgccacattgacargttcttcccaccagtgctcaacgtcacgtggctgtgcaacggggagctggtcactgagggtgtcgctgagagcctcttcctgcccagaacagattacagc

SEQ ID NO: 3004 - DNA, 201 bp, Homo sapiens
ctgagtagttaatatggtcaggcgctattctgaggatttacatttattaactcactttattctcacacatagtctttgaggtaggtactattattttcacyatttcacatgagagatacttacatctttttacatacacagagactttaagcactttgatcaagttcccacagctatgaagtagtagggctagcttccaat

SEQ ID NO: 3005 - DNA, 201 bp, Homo sapiens
gtctggatccaagactgtttatccactgtcctattcaccctattttgtgaaggaaaagaccaagttcaaattctccagagtccattgccaaataatggagycagatctatatttctatacataattacaacacagtgtggtgggtgcctgtaactacttactgtctctacttggactcattccatggcaatgttcacacaa

SEQ ID NO: 3006 - DNA, 201 bp, Homo sapiens
agttgtgaattacctacaatttcttccccatagagcttctgggaaccatgaaatcagggggaatacttgggtatctgttttaaggtcccagaacattccaygagaggcatcttgctcaatattctttgacaggagcaggtcagcctggagccacatcagtgacctccagggtgcgctggagttaaggcctgatacccaatg

SEQ ID NO: 3007 - DNA, 201 bp, Homo sapiens
tgggctccccccatgaatccccaacccaaagtcccctttccgcccggcactaaggtcccttaggccaacccggctgctcctgcgccctgggcacgggcccrcggggctgccctgggaccgccggcccaaagccctcactcacctcggcgctgcagggtcatgggcccgcccagctcgtagttgtgtctgcacatcctgtcc

SEQ ID NO: 3008 - DNA, 201 bp, Homo sapiens
actcttaaaacatctcctacagttttaaatttcacatttactactttaattcatctgggattcatctttgtgtttgatggggatcatgttttatttttctytatataatgggccagtgtgttcccacaactactaaatagttcaccttttccccataggttagtagtgtctcctttgctatactgaaagctcccattatag

SEQ ID NO: 3009 - DNA, 201 bp, Homo sapiens
cggagctgctccccctacttaactccctgactgacatttccatcctgatgtcagtcctggttcaaatgccacctcctccaggaagccctcccttccttctytctcttttccatagctaagcgctctctcttctcgaccagtttcttgagaattcctcaacttgctcctgttgttttgcatgtaggagatgtagaaatatat

SEQ ID NO: 3010 - DNA, 201 bp, Homo sapiens
aactgtatttttgtttgtgtgtcttttttaaaagaagtcttccctatactgagatatcaaagatactcttaaaacatctcctacagttttaaatttcacayttactactttaattcatctgggattcatctttgtgtttgatggggatcatgttttatttttctttatataatgggccagtgtgttcccacaactactaaa

SEQ ID NO: 3011 - DNA, 201 bp, Homo sapiens
attttgaaaaaactgaagctcaaaaagatgaataagttttccaaggttacacagcagatcaacgagccaagtttgaagtccagacccagctctgagggtcrtacactgccttccccagattcctgcacacagtgacctactatcagggccctcctatctctctgggatccccagcctctatcttttgtggctgctttacag

SEQ ID NO: 3012 - DNA, 201 bp, Homo sapiens
tcttattgatttgcaggtgatccttatatagtcctgctagtagtcccttgtcagttttaggcattgcaaatgttttcctctaatctgacttctggcaactktctccttggtttcctttattgaagagaaatccttaatattttgtaatgaagtccatcaactgtatttttgtttgtgtgtcttttttaaaagaagtcttcc

SEQ ID NO: 3013 - DNA, 201 bp, Homo sapiens
aggtgaatcccagccatgctgattcctctccacccatttccagtgctagaggcccacagtttcagtctcatctgcctccactcggcctcagttcctcatcrctgttcctgtgctcacagtcatcaattatagaccccacaacatgcgccctgaagacagaatgttccatatcagagctgtgatcttgagagccctctcctt

SEQ ID NO: 3014 - DNA, 201 bp, Homo sapiens
aactgcttttctctccataatctcctggcatcctctattccaaagacctggtgtcctctgcaccagctttccgcactggctgggtctcagtcctctcctcrtcctaacatccaattaactggtccataaccttcaattcccacaaccatcccaggccatcaccaccctcactgcacctcctgaccctatctcttcattctt

SEQ ID NO: 3015 - DNA, 201 bp, Homo sapiens
tgagcgatctcagcacagtaagatttgttgcacatcagcagcactttcagctccttgaggctgtggaccagaaacttctggaagccactgggcagcatgtkttttttgttgttgttgttgctcccataagcaatgttgggcatcaagatctggcccttggaccttctacgaaccctactgttaagacctctgggtttccgc

SEQ ID NO: 3016 - DNA, 201 bp, Homo sapiens
cattaggagacgaagtgcaaagagtgtttctgtatcctccctctcttctaggaccctagggctcttcctgggtctttgtgggtggtcacaagctttcctcyctcaagacagcagggttgcatggtcttgatagccttgtgattcgggttctgagagattcaggactgcaagggaggcctagacttttgatagctgcaagga

SEQ ID NO: 3017 - DNA, 201 bp, Homo sapiens
atccccctgaggtgaccgtgtttcccaaggagcctgtggagctgggccagcccaacaccctcatctgccacattgacaagttcttcccaccagtgctcaaygtcacgtggctgtgcaacggggagctggtcactgagggtgtcgctgagagcctcttcctgcccagaacagattacagcttccacaagttccattacctga

SEQ ID NO: 3018 - DNA, 201 bp, Homo sapiens
tgggatccccagcctctatcttttgtggctgctttacaggaactccgagctatggactctgcattaggagacgaagtgcaaagagtgtttctgtatcctcyctctcttctaggaccctagggctcttcctgggtctttgtgggtggtcacaagctttcctctctcaagacagcagggttgcatggtcttgatagccttgtg

SEQ ID NO: 3019 - DNA, 201 bp, Homo sapiens
ctgaggtgaccgtgtttcccaaggagcctgtggagctgggccagcccaacaccctcatctgccacattgacaagttcttcccaccagtgctcaacgtcacrtggctgtgcaacggggagctggtcactgagggtgtcgctgagagcctcttcctgcccagaacagattacagcttccacaagttccattacctgacctttg

SEQ ID NO: 3020 - DNA, 201 bp, Homo sapiens
gacctactatcagggccctcctatctctctgggatccccagcctctatcttttgtggctgctttacaggaactccgagctatggactctgcattaggagasgaagtgcaaagagtgtttctgtatcctccctctcttctaggaccctagggctcttcctgggtctttgtgggtggtcacaagctttcctctctcaagacag

SEQ ID NO: 3021 - DNA, 201 bp, Homo sapiens
tgtttcccaaggagcctgtggagctgggccagcccaacaccctcatctgccacattgacaagttcttcccaccagtgctcaacgtcacgtggctgtgcaayggggagctggtcactgagggtgtcgctgagagcctcttcctgcccagaacagattacagcttccacaagttccattacctgacctttgtgccctcagcag

SEQ ID NO: 3022 - DNA, 201 bp, Homo sapiens
ctctgcagttcccagggctgagccgtcctgctggttagttctcagcacccttctgtgactacaagttcaagttctcctccccttcctggacaatgaacccraggtaatagataagaggttttagggcttgaggggctgtattcaggagattccaaccttgctaccctgaaagatgaggaggtgacatgatgtcagtacctt

SEQ ID NO: 3023 - DNA, 201 bp, Homo sapiens
tttagaggcattgatgtaattttttttggcagtttttatggttttatttacacacaaaacgtggacatgaactttctactcattttcttagctgtgcaccstggtactggggttggtgactctgatggccggctgggtgactctttccatgatgactttgcagttctggaggaaattttgtgagcgatctcagcacagtaa

SEQ ID NO: 3024 - DNA, 201 bp, Homo sapiens
tacaaacctcaacccagcctttgcctgtcctccctttcactgcccagcatcacatgcccccttctgctctctgctcccccacctctgggtttccttggtgrctcccaacactgtccctcatcccacatgacagctctgcctatgggatgggggcgctgcatccgtcacttcctcctgacactgttcagtgtcaccagtgct

SEQ ID NO: 3025 - DNA, 201 bp, Homo sapiens
ttcattgagccttttatcctctgttctcctttgaagaacccctcactgtcaccttcccgagaataccctaagaccaataaatacttcagtatttcagagcrgggagactctgagtcattcttactggaagtctaggaccaggtcacatgtgaatactatttcttgaaggtgtggtttcaacctctgttgccgatgtggtta

SEQ ID NO: 3026 - DNA, 201 bp, Homo sapiens
cctcatgaacttgttggtcctctttttgaggatcttatccttcatgaggagtctgagggaggccatgatgtggaggaagagatggctgccagctgcatagrcagcaccgaggaagacagcattgatgtaatttttacatgaacaattttggcagcctttcccacatgctgttcttcctagggagtgccatgagcagtgtct

SEQ ID NO: 3027 - DNA, 201 bp, Homo sapiens
gccaacccggctgctcctgcgccctgggcacgggcccgcggggctgccctgggaccgccggcccaaagccctcactcacctcggcgctgcagggtcatggscccgcccagctcgtagttgtgtctgcacatcctgtccggcactgcccgcttctcctccaggatgtccttctggctgttccagtactccgcagcaggccgc

SEQ ID NO: 3028 - DNA, 201 bp, Homo sapiens
agcttccaatccagaaagtctggatccaagactgtttatccactgtcctattcaccctattttgtgaaggaaaagaccaagttcaaattctccagagtccrttgccaaataatggagtcagatctatatttctatacataattacaacacagtgtggtgggtgcctgtaactacttactgtctctacttggactcattcca

SEQ ID NO: 3029 - DNA, 201 bp, Homo sapiens
taggccaacccggctgctcctgcgccctgggcacgggcccgcggggctgccctgggaccgccggcccaaagccctcactcacctcggcgctgcagggtcaygggcccgcccagctcgtagttgtgtctgcacatcctgtccggcactgcccgcttctcctccaggatgtccttctggctgttccagtactccgcagcaggc

SEQ ID NO: 3030 - DNA, 201 bp, Homo sapiens
cccttttatctccagtccttactcccatatctaacctcttacccctacctcataggtaaacattttaatgaatttgatgtttccttttatttgcatagatsctctgtaatatgtagtagtgtccagtgtacatgtatttttaattaaccaaaatggcattaaattatagatctaattttgtacatccagtttgtttcttcc

SEQ ID NO: 3031 - DNA, 201 bp, Homo sapiens
cccaacccaaagtcccctttccgcccggcactaaggtcccttaggccaacccggctgctcctgcgccctgggcacgggcccgcggggctgccctgggaccsccggcccaaagccctcactcacctcggcgctgcagggtcatgggcccgcccagctcgtagttgtgtctgcacatcctgtccggcactgcccgcttctcct

SEQ ID NO: 3032 - DNA, 201 bp, Homo sapiens
ccttttcctttgaggctcagggcgggctggctaacattgctatattgaacaacaacttgaataccttgatccagcgttccaaccacactcaggccaccaayggtacgccctatctttgcctcttcctctgtagcccaactggaagggatgagagggcctctctgccaccctcagactaggaagcctaagtgccccctgctg

SEQ ID NO: 3033 - DNA, 201 bp, Homo sapiens
taatggagtcagatctatatttctatacataattacaacacagtgtggtgggtgcctgtaactacttactgtctctacttggactcattccatggcaatgytcacacaaaaaatgcccctccagagatcttacaggtttctatttatcataacactcaccatgctttatatttttatatgttttgggaattctcttagcat

SEQ ID NO: 3034 - DNA, 201 bp, Homo sapiens
tttatctccagtccttactcccatatctaacctcttacccctacctcataggtaaacattttaatgaatttgatgtttccttttatttgcatagatcctcygtaatatgtagtagtgtccagtgtacatgtatttttaattaaccaaaatggcattaaattatagatctaattttgtacatccagtttgtttcttccaaat

SEQ ID NO: 3035 - DNA, 201 bp, Homo sapiens
tgtggtgggtgcctgtaactacttactgtctctacttggactcattccatggcaatgttcacacaaaaaatgcccctccagagatcttacaggtttctatytatcataacactcaccatgctttatatttttatatgttttgggaattctcttagcattagacagtgaacttccatgcagatgaccacatctaattcatta

SEQ ID NO: 3036 - DNA, 201 bp, Homo sapiens
ttatctccagtccttactcccatatctaacctcttacccctacctcataggtaaacattttaatgaatttgatgtttccttttatttgcatagatcctctstaatatgtagtagtgtccagtgtacatgtatttttaattaaccaaaatggcattaaattatagatctaattttgtacatccagtttgtttcttccaaatc

SEQ ID NO: 3037 - DNA, 201 bp, Homo sapiens
gatgggtccgggcttacagtactgaacccaggaatgacaataactgtgtgtgttgctgcaggtgacaaaatatctgaacagaagaggacttaggagagatytgaactccagctgccctacaaactccatctcagcttttcttctcacttcatgtgaaaactactccagtggctgactgaattgctgacccttcaagctctg

SEQ ID NO: 3038 - DNA, 201 bp, Homo sapiens
ggaatgacaataactgtgtgtgttgctgcaggtgacaaaatatctgaacagaagaggacttaggagagatctgaactccagctgccctacaaactccatcwcagcttttcttctcacttcatgtgaaaactactccagtggctgactgaattgctgacccttcaagctctgtccttatccattacctcaaagcagtcattc

SEQ ID NO: 3039 - DNA, 201 bp, Homo sapiens
aaaactgccaaaaaaaattacatcaatgcctctaaacccaaaggactctacccccacaggtccctggttgttgtggtgattttcattgtgtaaaatacttyccacatcttttgacaccaagtctttctgcagccatgtttgaaaattaactttcaggctacagagtctttcttataccaaagttgaagaaagttttaagaa

SEQ ID NO: 3040 - DNA, 201 bp, Homo sapiens
gagaaggcaactagaacaaacaggaatccttgccttggtgaaatgtatttgaactgggtcagaaatgaggccattgggtatcaggccttaactccagcgcmccctggaggtcactgatgtggctccaggctgacctgctcctgtcaaagaatattgagcaagatgcctctcgtggaatgttctgggaccttaaaacagata

SEQ ID NO: 3041 - DNA, 201 bp, Homo sapiens
atcttcatgcacaggaggagcaagaaaggtgagaaagcctgcagggtgagcgggacttaccttcccctggcatattcacacttattccacgatgaggggtytgacagaaaagaaatgtcagaaagctctagaggccactgatatcagataatcggggaacaaacatgacctatagcgagagagggatcccaggctgggatc

SEQ ID NO: 3042 - DNA, 201 bp, Homo sapiens
aatggtgagcagactgcaaatctgcctgataggacccatattcccacagcactaattcaacatataccttactgagagcatgttttatcattaccattaakaagttaaatgaacatcagaatttaaaatcataaatataatctaatacactttaaccattttctttgtgtgccatcacaaatactccttaaccaaatacgg

SEQ ID NO: 3043 - DNA, 201 bp, Homo sapiens
agcactcacccttgatggccccagctcctcggagactcagcaggaaagccaaggagagggctctcaagatcacagctctgatatggaacattctgtcttcwgggcgcatgttgtggggtctataattgatgactgtgagcacaggaacagtgatgaggaactgaggccgagtggaggcagatgagactgaaactgtgggcc

SEQ ID NO: 3044 - DNA, 201 bp, Homo sapiens
tagaaaactaaaatagagtagagaatatcaaagaaattgtcatgggaagcaaagaatcgccttccaaagggccctgtcctgatcttattgcagatgagggygtcctcccacatttccaggagcagatcatgcctcttacacgtgtgattctagaacatagaatggaacagaatttttgagatcattttatgaggttggttc

SEQ ID NO: 3045 - DNA, 201 bp, Homo sapiens
agaaggtccaagggccagatcttgatgcccaacattgcttatgggagcaacaacaacaacaaaaaaaacatgctgcccagtggcttccagaagtttctggyccacagcctcaaggagctgaaagtgctgctgatgtgcaacaaatcttactgtgctgagatcgctcacaaaatttcctccagaactgcaaagtcatcatgg

SEQ ID NO: 3046 - DNA, 201 bp, Homo sapiens
tcacccgggtactagttacatgggtgcttgcggtgataaccattcaacgtacattctattggtttgtgtgtttcttccaaatgtcccctagttcacaataraaagggcttaaatagagaagtaaaggagaatttgggaatttgaagcaaaagcaagaagccactgaatcaagcacaaatattgagctttgataaagattgg

SEQ ID NO: 3047 - DNA, 201 bp, Homo sapiens
accccagtaccagggtgcacagctaagaaaatgagtagaaagttcatgtccacgttttgtgtgtaaataaaaccataaaaactgccaaaaaaaattacatsaatgcctctaaacccaaaggactctacccccacaggtccctggttgttgtggtgattttcattgtgtaaaatactttccacatcttttgacaccaagtct

SEQ ID NO: 3048 - DNA, 201 bp, Homo sapiens
ggactttgggttggggattcatggggggagcccatctggagcttgtcaggggagcgagcgcggggacctggactgggctgagcatggagtgaggaggacgrgagcagagagacccccgggacttcatcaggcctggcagctgactgcatgtggggtgaaaaaaggaagccacaggacagcgcacaagggtatggtgtggag

SEQ ID NO: 3049 - DNA, 201 bp, Homo sapiens
attcatggggggagcccatctggagcttgtcaggggagcgagcgcggggacctggactgggctgagcatggagtgaggaggacgagagcagagagaccccsgggacttcatcaggcctggcagctgactgcatgtggggtgaaaaaaggaagccacaggacagcgcacaagggtatggtgtggagatggaggtggagatgg

SEQ ID NO: 3050 - DNA, 201 bp, Homo sapiens
gtgtgcagtaagaggatttctcaaggatgggacaggaaggccttggagctttggcttcctcctgtgaacttgtggggtggggagcctggtgcaccaacctkagggacttgagggagtagtatcaggatgtgggattgagccctggaccttttttctagaaagaggaaaaaaatgaagggaggaggaggaggaagctgggga

SEQ ID NO: 3051 - DNA, 201 bp, Homo sapiens
ccacactcagagtggggcaattgaacaggcaggggcggatggatggcagaggaggaggaatctggactcaaggagctggggggctctgggcctggaatttyagggtctggggcccaaggcaccaggagaagaggcaggtcaggatatctgagtcaagacctgggatcttgccttagcaatgacactggagactaaaggtgg

SEQ ID NO: 3052 - DNA, 201 bp, Homo sapiens
tgtgcagtaagaggatttctcaaggatgggacaggaaggccttggagctttggcttcctcctgtgaacttgtggggtggggagcctggtgcaccaacctgwgggacttgagggagtagtatcaggatgtgggattgagccctggaccttttttctagaaagaggaaaaaaatgaagggaggaggaggaggaagctggggag

SEQ ID NO: 3053 - DNA, 201 bp, Homo sapiens
aggtttgtagggggaatgagatgaggcagtggagccatgtgacagggactgagggtagattactggagctccctgcgtagaatgaatgttcaatcaaaacytgctggagggagagctggagccataggggagtgggtaaagtgggcagggctgattccacaattccctgcatgctcccccaactccacacacatccccaac

SEQ ID NO: 3054 - DNA, 201 bp, Homo sapiens
ccgcaggtccccaacctcactcctctgaagactcttctggagatcctctgtgatgcacagatctccagactcagtgcccccagactcagattccctgggtrgggaggtctggggatctctgcttgtaatcagctccctagaggttcccatgtagccagataagtattgtcagaacactgaagatttttgaaaaatgaaaaa

SEQ ID NO: 3055 - DNA, 201 bp, Homo sapiens
atgggaacgagggtcagatagtggaacctgtgtaatctgagtttcttgctgggcaggaagatggtctctgcaataccctcaatgactggctccccattgcrcagccacgtgatgttcagcactggtgggaagaacttgtcaacatggcagacgagggtgttgggctggcccagatccacaggctccttgggaaagacgctt

SEQ ID NO: 3056 - DNA, 201 bp, Homo sapiens
ctacctcctggcctaaggaggggcacagggatgctggcaacagtctatttcttcacccgggtactagttacatgggtgcttgcggtgataaccattcaacrtacattctattggtttgtgtgtttcttccaaatgtcccctagttcacaatagaaagggcttaaatagagaagtaaaggagaatttgggaatttgaagcaa

SEQ ID NO: 3057 - DNA, 201 bp, Homo sapiens
aaattctctctctgcgtggtgagaaaacaggcctggagaggctctgcgacccgcttaggaccacagaactcggtactaggaaaactcctattttaaaatcyagccctgggtgggaagatttgggaagaatcgttaatattgagagagagagggagaaagaggattagatgagagtggcgcctccgctcatgtccgccccct

SEQ ID NO: 3058 - DNA, 201 bp, Homo sapiens
tgcatgaggctgagtgtggcgcatcctcctcggggctgagatggattttacttgtcttgggttccccacggctgtcacagggcagtgtctcagttcattcrtctttttccttcaggaagtctgggtgtaaagggatggagagaggtgaggtgtgtgcagtaagaggatttctcaaggatgggacaggaaggccttggagct

SEQ ID NO: 3059 - DNA, 201 bp, Homo sapiens
tcaatttcttttacacagtaagaataggatcagctgtgctaaactaacaaatacccagatatccaggtttggctcatgctacacgtccaaagtaagtcatscaggaagctctgcttatcatcgtactcaggaagccaggctgacagtctttctcctgcacatctgctcccagaacctccccagcagaatgaagggaaccta

SEQ ID NO: 3060 - DNA, 201 bp, Homo sapiens
tctctgcgtggtgagaaaacaggcctggagaggctctgcgacccgcttaggaccacagaactcggtactaggaaaactcctattttaaaatccagccctgrgtgggaagatttgggaagaatcgttaatattgagagagagagggagaaagaggattagatgagagtggcgcctccgctcatgtccgccccctccccgcag

SEQ ID NO: 3061 - DNA, 201 bp, Homo sapiens
cccaacctcactcctctgaagactcttctggagatcctctgtgatgcacagatctccagactcagtgcccccagactcagattccctgggtggggaggtckggggatctctgcttgtaatcagctccctagaggttcccatgtagccagataagtattgtcagaacactgaagatttttgaaaaatgaaaaagagaaggtt

SEQ ID NO: 3062 - DNA, 201 bp, Homo sapiens
aggaaggatgcagtgcagagacaggtcccagaggagacaagagctgagagaccatccaaactgggaccaccttgtcactagacttcaaattttcaatattkatagagtgttttctaagagtcaggccctttgctgagtgctatgtgcagcaggatcaaaggcagccaggaggtagaggagtcttgaggtacatcagtcatt

SEQ ID NO: 3063 - DNA, 201 bp, Homo sapiens
cgtggtgagaaaacaggcctggagaggctctgcgacccgcttaggaccacagaactcggtactaggaaaactcctattttaaaatccagccctgggtgggwagatttgggaagaatcgttaatattgagagagagagggagaaagaggattagatgagagtggcgcctccgctcatgtccgccccctccccgcagagaatt

SEQ ID NO: 3064 - DNA, 201 bp, Homo sapiens
gtgtgaataaactctggtagaggccagaccatctccttctcatccaggttcacgtagaactgctcctcctcatcaaattcaaacatatactccccagaggktctgtgcgtctgcacaaactccgcatatgttgacacatggtctgctgcatgaaggagaagatggagaatgggtgaatacgtaggatgctacacagaatgc

SEQ ID NO: 3065 - DNA, 201 bp, Homo sapiens
caattgaacaggcaggggcggatggatggcagaggaggaggaatctggactcaaggagctggggggctctgggcctggaattttagggtctggggcccaasgcaccaggagaagaggcaggtcaggatatctgagtcaagacctgggatcttgccttagcaatgacactggagactaaaggtggactccatggtgcccttg

SEQ ID NO: 3066 - DNA, 201 bp, Homo sapiens
gaggtttgtagggggaatgagatgaggcagtggagccatgtgacagggactgagggtagattactggagctccctgcgtagaatgaatgttcaatcaaaayctgctggagggagagctggagccataggggagtgggtaaagtgggcagggctgattccacaattccctgcatgctcccccaactccacacacatccccaa

SEQ ID NO: 3067 - DNA, 201 bp, Homo sapiens
gcaggtgtttatgaaactctgggatttctaaggaaggatgcagtgcagagacaggtcccagaggagacaagagctgagagaccatccaaactgggaccacyttgtcactagacttcaaattttcaatattgatagagtgttttctaagagtcaggccctttgctgagtgctatgtgcagcaggatcaaaggcagccaggag

SEQ ID NO: 3068 - DNA, 201 bp, Homo sapiens
gtgggatgagggacagtgttgggagccaccaaggaaacccagaggtgggggagcagagagcagaagggggcatgtgatgctgggcagtgaaagggaggacrggcaaaggctgggttgaggtttgtagggggaatgagatgaggcagtggagccatgtgacagggactgagggtagattactggagctccctgcgtagaatg

SEQ ID NO: 3069 - DNA, 201 bp, Homo sapiens
tcagccctgggaactgcagaggggtgaggctggggagagaggaggctggagcagcactggtgacactgaacagtgtcaggaggaagtgacggatgcagcgyccccatcccataggcagagctgtcatgtgggatgagggacagtgttgggagccaccaaggaaacccagaggtgggggagcagagagcagaagggggcatg

SEQ ID NO: 3070 - DNA, 201 bp, Homo sapiens
ctcagccctgggaactgcagaggggtgaggctggggagagaggaggctggagcagcactggtgacactgaacagtgtcaggaggaagtgacggatgcagcrcccccatcccataggcagagctgtcatgtgggatgagggacagtgttgggagccaccaaggaaacccagaggtgggggagcagagagcagaagggggcat

SEQ ID NO: 3071 - DNA, 201 bp, Homo sapiens
cggctcagccctgggaactgcagaggggtgaggctggggagagaggaggctggagcagcactggtgacactgaacagtgtcaggaggaagtgacggatgcrgcgcccccatcccataggcagagctgtcatgtgggatgagggacagtgttgggagccaccaaggaaacccagaggtgggggagcagagagcagaaggggg

SEQ ID NO: 3072 - DNA, 201 bp, Homo sapiens
taaccagcaggacggctcagccctgggaactgcagaggggtgaggctggggagagaggaggctggagcagcactggtgacactgaacagtgtcaggaggargtgacggatgcagcgcccccatcccataggcagagctgtcatgtgggatgagggacagtgttgggagccaccaaggaaacccagaggtgggggagcagag

SEQ ID NO: 3073 - DNA, 201 bp, Homo sapiens
tgggagggggtgcatgaggctgagtgtggcgcatcctcctcggggctgagatggattttacttgtcttgggttccccacggctgtcacagggcagtgtctsagttcattcgtctttttccttcaggaagtctgggtgtaaagggatggagagaggtgaggtgtgtgcagtaagaggatttctcaaggatgggacaggaagg

SEQ ID NO: 3074 - DNA, 201 bp, Homo sapiens
tagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaaca

SEQ ID NO: 3075 - DNA, 201 bp, Homo sapiens
gtctttggggaaaatgggaccaagaggtcctggataaccttggacagacaaggtttgcagagagagaagttggcaagtgcaggctcctgggcgtgttcatrtctgcatccagcctggaggggactcaggcagagagccctaagctggagtgtccaggctctgaggatcactgaggattcagtgctcacgaagaatgcctct

SEQ ID NO: 3076 - DNA, 201 bp, Homo sapiens
cctggagaggctctgcgacccgcttaggaccacagaactcggtactaggaaaactcctattttaaaatccagccctgggtgggaagatttgggaagaatcsttaatattgagagagagagggagaaagaggattagatgagagtggcgcctccgctcatgtccgccccctccccgcagagaattaccttttccagggacgg

SEQ ID NO: 3077 - DNA, 201 bp, Homo sapiens
cctgatccgtaatggagactggaccttccagatcctggtgatgctggaaatgaccccccagcagggagatgtctacacctgccaagtggagcacaccagcmtggatagtcctgtcaccgtggagtggagtgagtctctgatgaccctctagaccccacctctgaagagcaggggactctctggctctggggtccactcatc

SEQ ID NO: 3078 - DNA, 201 bp, Homo sapiens
tgtctttggggaaaatgggaccaagaggtcctggataaccttggacagacaaggtttgcagagagagaagttggcaagtgcaggctcctgggcgtgttcaygtctgcatccagcctggaggggactcaggcagagagccctaagctggagtgtccaggctctgaggatcactgaggattcagtgctcacgaagaatgcctc

SEQ ID NO: 3079 - DNA, 201 bp, Homo sapiens
caatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatct

SEQ ID NO: 3080 - DNA, 201 bp, Homo sapiens
gggtacagtaaacagagagaggtgcccagtggtcagtgcttgtctttggggaaaatgggaccaagaggtcctggataaccttggacagacaaggtttgcasagagagaagttggcaagtgcaggctcctgggcgtgttcatgtctgcatccagcctggaggggactcaggcagagagccctaagctggagtgtccaggctc

SEQ ID NO: 3081 - DNA, 201 bp, Homo sapiens
aaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgt

SEQ ID NO: 3082 - DNA, 201 bp, Homo sapiens
aggaaggaaagaaggacaatctcaaattctatttcattatttttcttccacgctcctagtccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 3083 - DNA, 201 bp, Homo sapiens
atttgggaagaatcgttaatattgagagagagagggagaaagaggattagatgagagtggcgcctccgctcatgtccgccccctccccgcagagaattacsttttccagggacggcaggaatgctacgcgtttaatgggacacagcgcttcctggagagatacatctacaaccgggaggagttcgcgcgcttcgacagcga

SEQ ID NO: 3084 - DNA, 201 bp, Homo sapiens
ttgggaagaatcgttaatattgagagagagagggagaaagaggattagatgagagtggcgcctccgctcatgtccgccccctccccgcagagaattacctkttccagggacggcaggaatgctacgcgtttaatgggacacagcgcttcctggagagatacatctacaaccgggaggagttcgcgcgcttcgacagcgacg

SEQ ID NO: 3085 - DNA, 201 bp, Homo sapiens
gggaagaatcgttaatattgagagagagagggagaaagaggattagatgagagtggcgcctccgctcatgtccgccccctccccgcagagaattacctttwccagggacggcaggaatgctacgcgtttaatgggacacagcgcttcctggagagatacatctacaaccgggaggagttcgcgcgcttcgacagcgacgtg

SEQ ID NO: 3086 - DNA, 201 bp, Homo sapiens
  misc_feature (1)...(201): n = A,T,C or G, or insertion/deletion polymorphism (see Tables 1-2)
gaatcgttaatattgagagagagagggagaaagaggattagatgagagtggcgcctccgctcatgtccgccccctccccgcagagaattaccttttccagngacggcaggaatgctacgcgtttaatgggacacagcgcttcctggagagatacatctacaaccgggaggagttcgcgcgcttcgacagcgacgtggggga

SEQ ID NO: 3087 - DNA, 201 bp, Homo sapiens
ctgagacgcatcctctcaccataatttttctctcctggacttacaggaaggaggctggcaacctgggataacttgtcttttacccccacagggttcctgasctcactgaaaagactattgtgccttaggaaaagcatttgctgtgtttcgttagcatctggctccaggacagaccttcaacttccaaattggatactgctg

SEQ ID NO: 3088 - DNA, 201 bp, Homo sapiens
agtggggcaattgaacaggcaggggcggatggatggcagaggaggaggaatctggactcaaggagctggggggctctgggcctggaattttagggtctggsgcccaaggcaccaggagaagaggcaggtcaggatatctgagtcaagacctgggatcttgccttagcaatgacactggagactaaaggtggactccatggt

SEQ ID NO: 3089 - DNA, 201 bp, Homo sapiens
gggtgaatgtttccccctccaagaaggggcccttgcagcaccacaacctgcttgtctgccacgtgacggatttctacccaggcagcattcaagtccgatgsttcctgaatggacaggaggaaacagctggggtcgtgtccaccaacctgatccgtaatggagactggaccttccagatcctggtgatgctggaaatgaccc

SEQ ID NO: 3090 - DNA, 201 bp, Homo sapiens
gcaggtttctgcggccccccggacagtggctctgacggcgttactgatggtgctgctcacatctgtggtccagggcagggccactccaggtaagagccgarctgccattcttggagggtctggctcagggaacaattcctaggggacgttatctttaagggatcaaattctgagacaggctgcgggggctcctgccctaag

SEQ ID NO: 3091 - DNA, 201 bp, Homo sapiens
ggaaatgaccccccagcagggagatgtctacacctgccaagtggagcacaccagcctggatagtcctgtcaccgtggagtggagtgagtctctgatgaccvtctagaccccacctctgaagagcaggggactctctggctctggggtccactcatcttatcttctgcatctataccctggggccatgtccaaaccccatct

SEQ ID NO: 3092 - DNA, 201 bp, Homo sapiens
ataggcagagctgtcatgtgggatgagggacagtgttgggagccaccaaggaaacccagaggtgggggagcagagagcagaagggggcatgtgatgctggrcagtgaaagggaggacaggcaaaggctgggttgaggtttgtagggggaatgagatgaggcagtggagccatgtgacagggactgagggtagattactgga

SEQ ID NO: 3093 - DNA, 201 bp, Homo sapiens
cagcgcccccatcccataggcagagctgtcatgtgggatgagggacagtgttgggagccaccaaggaaacccagaggtgggggagcagagagcagaagggrgcatgtgatgctgggcagtgaaagggaggacaggcaaaggctgggttgaggtttgtagggggaatgagatgaggcagtggagccatgtgacagggactga

SEQ ID NO: 3094 - DNA, 201 bp, Homo sapiens
tgaggtgcttgaggggcagatgggtggtctgatgggcaggtagacagaagggtctgcagccggggaggagactgagatacatgagaccatccagggagagrggacccagggggaagagcaaaggaccggatcctgggaactggacagttgtgatttggccaagacagaaaagcctgtgaaagagaccaaaaaaacccaagt

SEQ ID NO: 3095 - DNA, 201 bp, Homo sapiens
caaccattgtactctcaggacatttctagtccaaatttacaccaacactctgagaggaaggactgcaaagtaggtaccttagttttccactgacttccacytttcctgcttacacccttcctcctagacctctccacacccctcctaggacacacctagaaggtactgacatcatgtcacctcctcatctttcagggtagc

SEQ ID NO: 3096 - DNA, 201 bp, Homo sapiens
cagcgcttcctggagagatacatctacaaccgggaggagttcgcgcgcttcgacagcgacgtgggggagttccgggcggtgacggagctggggcggcctgmtgcggagtactggaacagccagaaggacatcctggaggagaagcgggcagtgccggacaggatgtgcagacacaactacgagctgggcgggcccatgacc

SEQ ID NO: 3097 - DNA, 201 bp, Homo sapiens
gcagatgcagtggctcaggcccgtaatcccagccctttgagaggccgagcgggtggatcacttgaggtcaggcgttggtcaagtgctcctagagaaccagsctgaccaacatggagaaaccttgtctctactaataatacaaaaattagccaggtgaagtggcaggcacctataatcccagctattcgggaggctgaggaa

SEQ ID NO: 3098 - DNA, 201 bp, Homo sapiens
acatagactatgaggaccagatagatcaatgagcccctaaaatctgtgatccctgaagcagcaattgatgtgaaccaccccatcactcaccccgacgctcytgcgtcctcctgagcactcacccttgatggccccagctcctcggagactcagcaggaaagccaaggagagggctctcaagatcacagctctgatatggaa

SEQ ID NO: 3099 - DNA, 201 bp, Homo sapiens
tatgtgtgcatgtgtctttatagcagcatgatttataatcctttgggtatatatccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggag

SEQ ID NO: 3100 - DNA, 201 bp, Homo sapiens
ctactggcctattctctctccaaggacatgggtacagtaaacagagagaggtgcccagtggtcagtgcttgtctttggggaaaatgggaccaagaggtccwggataaccttggacagacaaggtttgcagagagagaagttggcaagtgcaggctcctgggcgtgttcatgtctgcatccagcctggaggggactcaggca

SEQ ID NO: 3101 - DNA, 201 bp, Homo sapiens
cttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatggctgcacagtattccatggtgtatatgtgtgcattttcttaatccag

SEQ ID NO: 3102 - DNA, 201 bp, Homo sapiens
  misc_feature (1)...(201): n = A,T,C or G, or insertion/deletion polymorphism (see Tables 1-2)
aatcgttaatattgagagagagagggagaaagaggattagatgagagtggcgcctccgctcatgtccgccccctccccgcagagaattaccttttccaggnacggcaggaatgctacgcgtttaatgggacacagcgcttcctggagagatacatctacaaccgggaggagttcgcgcgcttcgacagcgacgtgggggag

SEQ ID NO: 3103 - DNA, 201 bp, Homo sapiens
tgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaa

SEQ ID NO: 3104 - DNA, 201 bp, Homo sapiens
ctccccgcagagaattaccttttccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 3105 - DNA, 201 bp, Homo sapiens
cccgcagagaattaccttttccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 3106 - DNA, 201 bp, Homo sapiens
cgcttcctggagagatacatctacaaccgggaggagttcgcgcgcttcgacagcgacgtgggggagttccgggcggtgacggagctggggcggcctgctgmggagtactggaacagccagaaggacatcctggaggagaagcgggcagtgccggacaggatgtgcagacacaactacgagctgggcgggcccatgaccctg

SEQ ID NO: 3107 - DNA, 201 bp, Homo sapiens
gacagtggctctgacggcgttactgatggtgctgctcacatctgtggtccagggcagggccactccaggtaagagccgaactgccattcttggagggtctrgctcagggaacaattcctaggggacgttatctttaagggatcaaattctgagacaggctgcgggggctcctgccctaaggcagtgtcctctcttcccagc

SEQ ID NO: 3108 - DNA, 201 bp, Homo sapiens
tcctggagagatacatctacaaccgggaggagttcgcgcgcttcgacagcgacgtgggggagttccgggcggtgacggagctggggcggcctgctgcggastactggaacagccagaaggacatcctggaggagaagcgggcagtgccggacaggatgtgcagacacaactacgagctgggcgggcccatgaccctgcagc

SEQ ID NO: 3109 - DNA, 201 bp, Homo sapiens
ccgggaggagttcgcgcgcttcgacagcgacgtgggggagttccgggcggtgacggagctggggcggcctgctgcggagtactggaacagccagaaggacmtcctggaggagaagcgggcagtgccggacaggatgtgcagacacaactacgagctgggcgggcccatgaccctgcagcgccgaggtgagtgagggctttg

SEQ ID NO: 3110 - DNA, 201 bp, Homo sapiens
agagggaacatagactatgaggaccagatagatcaatgagcccctaaaatctgtgatccctgaagcagcaattgatgtgaaccaccccatcactcaccccracgctcctgcgtcctcctgagcactcacccttgatggccccagctcctcggagactcagcaggaaagccaaggagagggctctcaagatcacagctctga

SEQ ID NO: 3111 - DNA, 201 bp, Homo sapiens
aggaaggaaggaaggaaggaaggaaggaaggaaggaaggaaagaaggacaatctcaaattctatttcattatttttcttccacgctcctagtccagcctarggtgaatgtttccccctccaagaaggggcccttgcagcaccacaacctgcttgtctgccacgtgacggatttctacccaggcagcattcaagtccgatgg

SEQ ID NO: 3112 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgaggtgagtgagggctttgggccggcggtcccagggcagccccgcgggcccgtgcccagggcgcaggagcagccgggttggcct

SEQ ID NO: 3113 - DNA, 201 bp, Homo sapiens
acgctcctagtccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 3114 - DNA, 201 bp, Homo sapiens
attctatttcattatttttcttccacgctcctagtccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 3115 - DNA, 201 bp, Homo sapiens
aaggaaggaaggaaagaaggacaatctcaaattctatttcattatttttcttccacgctcctagtccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 3116 - DNA, 201 bp, Homo sapiens
cccagctgagtgttgtatcctccatccctttccacctggtcccttcattttctacccctcacagttccctaacgagaaggtggtccacccaacagacaacrctgcctcagatggttatcaaggggtaccctaagaagaaatcatctcaccctctctttgtccccatttgtcaagtagcagtgaggccgagccaggggatgg

SEQ ID NO: 3117 - DNA, 201 bp, Homo sapiens
tggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactca

SEQ ID NO: 3118 - DNA, 201 bp, Homo sapiens
taaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagc

SEQ ID NO: 3119 - DNA, 201 bp, Homo sapiens
cagtgcccctgagctcattcttttcagtaaattctctctctgcgtggtgagaaaacaggcctggagaggctctgcgacccgcttaggaccacagaactcgrtactaggaaaactcctattttaaaatccagccctgggtgggaagatttgggaagaatcgttaatattgagagagagagggagaaagaggattagatgaga

SEQ ID NO: 3120 - DNA, 201 bp, Homo sapiens
atctataccctggggccatgtccaaaccccatctttcttctataccagctcctgagcatagtttgaagccagggaaatggagacttcctgaccttggcttrggggttcctgaagattcatagttctcccccttgtcagagaatctagggacactgactggtctcgaaaccctcacacttaggaactgacctcacacatagg

SEQ ID NO: 3121 - DNA, 201 bp, Homo sapiens
gccaccagcagaagggactgccttcccctcagtgctcgcccctccctagtgatcactcagtgcccctgagctcattcttttcagtaaattctctctctgcrtggtgagaaaacaggcctggagaggctctgcgacccgcttaggaccacagaactcggtactaggaaaactcctattttaaaatccagccctgggtgggaa

SEQ ID NO: 3122 - DNA, 201 bp, Homo sapiens
gggttggttccaagtctttgctattgtgaatagtgccgcaataaacatatgtgtgcatgtgtctttatagcagcatgatttataatcctttgggtatatayccagtaatgggatggctgggtcaaatggtatttctagttctagatctttgaggaattgccacactgtcttgagataccatctcacaccagttaaaatggc

SEQ ID NO: 3123 - DNA, 201 bp, Homo sapiens
cagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatatccagtaatgggatggctgggtcaaatggtatttctagtt

SEQ ID NO: 3124 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgaggtgagtgagggctttgggccggcggtcc

SEQ ID NO: 3125 - DNA, 201 bp, Homo sapiens
agagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttgg

SEQ ID NO: 3126 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgaggtgagtgagggctttgggccggcggtcccagggcagccccgcgggcccg

SEQ ID NO: 3127 - DNA, 201 bp, Homo sapiens
gtagaaaaaaatacaaaattgagaggaagaagaaaatatccttcaaattttagggctcttgacagttttaaagtttctgtcttagtttatgaacatgaaamtgtagaatgtatagctttgttgataatatttttcatttggggcatataaattcaaaagtacagtacagttattttggcatttgttccaaacttttgtttc

SEQ ID NO: 3128 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggtgagtgagggctttgggccggcggtcccagggcagccccgcgggcccgtg

SEQ ID NO: 3129 - DNA, 201 bp, Homo sapiens
gtctgatgggcaggtagacagaagggtctgcagccggggaggagactgagatacatgagaccatccagggagaggggacccagggggaagagcaaaggacyggatcctgggaactggacagttgtgatttggccaagacagaaaagcctgtgaaagagaccaaaaaaacccaagtgcagtgtgaggagaggcccgcagaga

SEQ ID NO: 3130 - DNA, 201 bp, Homo sapiens
gtggtctttggttttttgtccttgcaatagtttgctgtgaatgatgatttccagcttcctccatgtccctacaaaggacatgaactcatccttttttatgrctgcacagtattccatggtgtatatgtgtgcattttcttaatccagtctatcactgatggacagttgggttggttccaagtctttgctattgtgaatagt

SEQ ID NO: 3131 - DNA, 201 bp, Homo sapiens
atgttttctgggcattagagaaggcaactagaacaaacaggaatccttgccttggtgaaatgtatttgaactgggtcagaaatgaggccattgggtatcargccttaactccagcgcaccctggaggtcactgatgtggctccaggctgacctgctcctgtcaaagaatattgagcaagatgcctctcgtggaatgttctg

SEQ ID NO: 3132 - DNA, 201 bp, Homo sapiens
tgtgctaaactaacaaatacccagatatccaggtttggctcatgctacacgtccaaagtaagtcatccaggaagctctgcttatcatcgtactcaggaagycaggctgacagtctttctcctgcacatctgctcccagaacctccccagcagaatgaagggaacctaagaatttattcactggcttttaatgatccctcct

SEQ ID NO: 3133 - DNA, 201 bp, Homo sapiens
ttacacgtgtgattctagaacatagaatggaacagaatttttgagatcattttatgaggttggttcatttatatttccagagccagctaagaatagtacargagaacaggattgtggactaattttagccatgtcactgaatccaacagtacattataaaaacaatacgttttgaccaattttagatttattctaggaatg

SEQ ID NO: 3134 - DNA, 201 bp, Homo sapiens
agcattcaagtccgatggttcctgaatggacaggaggaaacagctggggtcgtgtccaccaacctgatccgtaatggagactggaccttccagatcctggwgatgctggaaatgaccccccagcagggagatgtctacacctgccaagtggagcacaccagcctggatagtcctgtcaccgtggagtggagtgagtctctg

SEQ ID NO: 3135 - DNA, 201 bp, Homo sapiens
gctctgcgacccgcttaggaccacagaactcggtactaggaaaactcctattttaaaatccagccctgggtgggaagatttgggaagaatcgttaatattragagagagagggagaaagaggattagatgagagtggcgcctccgctcatgtccgccccctccccgcagagaattaccttttccagggacggcaggaatgc

SEQ ID NO: 3136 - DNA, 201 bp, Homo sapiens
ccgccccctccccgcagagaattaccttttccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 3137 - DNA, 201 bp, Homo sapiens
gagattcagaacgaaaagggtaaatgacatttatacacattttaaaatgcaaaatcttacgaccaactctatacatataaatttgaaaatttagataaaamggatacgtttctagaaagatataaaggtcaaaactacaggaagaaatagaaaactaaaatagagtagagaatatcaaagaaattgtcatgggaagcaaag

SEQ ID NO: 3138 - DNA, 201 bp, Homo sapiens
atgaaaatgggagaatccacactcagagtggggcaattgaacaggcaggggcggatggatggcagaggaggaggaatctggactcaaggagctggggggcyctgggcctggaattttagggtctggggcccaaggcaccaggagaagaggcaggtcaggatatctgagtcaagacctgggatcttgccttagcaatgacac

SEQ ID NO: 3139 - DNA, 201 bp, Homo sapiens
caccttgttgaggtcacacccctgttccagatatgagggtggctctttctgaatttcctcttagcaagctttttccgctgcactgtcctcatcccgatatkctgcatcaggctccagaatctcagacaggacatgagtagggatgcagctggtggaggtgacactaaacctgggtctgtccttcccagaggcacagtctga

SEQ ID NO: 3140 - DNA, 201 bp, Homo sapiens
gtgcttccttgccatgacgatgccagcaatacccctctgagaggaacaggcagctataggcagtgccatttgtggcccaagtctgtttggaccattgatcygggtgttcaagtgcttccttgccatgacgatgccagcaatacccctctgagcaccaaagtcaaaggtgtgaataaactctggtagaggccagaccatctc

SEQ ID NO: 3141 - DNA, 201 bp, Homo sapiens
agaacaaacaggaatccttgccttggtgaaatgtatttgaactgggtcagaaatgaggccattgggtatcaggccttaactccagcgcaccctggaggtcrctgatgtggctccaggctgacctgctcctgtcaaagaatattgagcaagatgcctctcgtggaatgttctgggaccttaaaacagatacccaagtattcc

SEQ ID NO: 3142 - DNA, 201 bp, Homo sapiens
gtaagaggatttctcaaggatgggacaggaaggccttggagctttggcttcctcctgtgaacttgtggggtggggagcctggtgcaccaacctgagggacytgagggagtagtatcaggatgtgggattgagccctggaccttttttctagaaagaggaaaaaaatgaagggaggaggaggaggaagctggggagatcaca

SEQ ID NO: 3143 - DNA, 201 bp, Homo sapiens
gaccagatagatcaatgagcccctaaaatctgtgatccctgaagcagcaattgatgtgaaccaccccatcactcaccccgacgctcctgcgtcctcctgascactcacccttgatggccccagctcctcggagactcagcaggaaagccaaggagagggctctcaagatcacagctctgatatggaacattctgtcttcag

SEQ ID NO: 3144 - DNA, 201 bp, Homo sapiens
cgcatcctctcaccataatttttctctcctggacttacaggaaggaggctggcaacctgggataacttgtcttttacccccacagggttcctgagctcacygaaaagactattgtgccttaggaaaagcatttgctgtgtttcgttagcatctggctccaggacagaccttcaacttccaaattggatactgctgccaaga

SEQ ID NO: 3145 - DNA, 201 bp, Homo sapiens
attatttttcttccacgctcctagtccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 3146 - DNA, 201 bp, Homo sapiens
aggaggaaacagctggggtcgtgtccaccaacctgatccgtaatggagactggaccttccagatcctggtgatgctggaaatgaccccccagcagggagaygtctacacctgccaagtggagcacaccagcctggatagtcctgtcaccgtggagtggagtgagtctctgatgaccctctagaccccacctctgaagagca

SEQ ID NO: 3147 - DNA, 201 bp, Homo sapiens
tcccacatttccaggagcagatcatgcctcttacacgtgtgattctagaacatagaatggaacagaatttttgagatcattttatgaggttggttcatttrtatttccagagccagctaagaatagtacaggagaacaggattgtggactaattttagccatgtcactgaatccaacagtacattataaaaacaatacgtt

SEQ ID NO: 3148 - DNA, 201 bp, Homo sapiens
acagctggggtcgtgtccaccaacctgatccgtaatggagactggaccttccagatcctggtgatgctggaaatgaccccccagcagggagatgtctacayctgccaagtggagcacaccagcctggatagtcctgtcaccgtggagtggagtgagtctctgatgaccctctagaccccacctctgaagagcaggggactc

SEQ ID NO: 3149 - DNA, 201 bp, Homo sapiens
tccgtaatggagactggaccttccagatcctggtgatgctggaaatgaccccccagcagggagatgtctacacctgccaagtggagcacaccagcctggayagtcctgtcaccgtggagtggagtgagtctctgatgaccctctagaccccacctctgaagagcaggggactctctggctctggggtccactcatcttatc

SEQ ID NO: 3150 - DNA, 201 bp, Homo sapiens
ttattccacgatgaggggtttgacagaaaagaaatgtcagaaagctctagaggccactgatatcagataatcggggaacaaacatgacctatagcgagagdgggatcccaggctgggatcttaatgcagccagatgcatgaggtcccaagtactcaggctcctgcggagcgtccattgagtgatgggcaatggaatttggt

SEQ ID NO: 3151 - DNA, 201 bp, Homo sapiens
cctccccgcagagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 3152 - DNA, 201 bp, Homo sapiens
attcacacttattccacgatgaggggtttgacagaaaagaaatgtcagaaagctctagaggccactgatatcagataatcggggaacaaacatgacctatrgcgagagagggatcccaggctgggatcttaatgcagccagatgcatgaggtcccaagtactcaggctcctgcggagcgtccattgagtgatgggcaatgg

SEQ ID NO: 3153 - DNA, 201 bp, Homo sapiens
tcaggatggaaatgtcagtcagggagttaagtagggggagcagctccgccctccacgtccccagctcctcccgcccctgttttttctcccagtgaccccamgtgaaacgtctccgcctcctccagccaccagcagaagggactgccttcccctcagtgctcgcccctccctagtgatcactcagtgcccctgagctcattc

SEQ ID NO: 3154 - DNA, 201 bp, Homo sapiens
cgggacttaccttcccctggcatattcacacttattccacgatgaggggtttgacagaaaagaaatgtcagaaagctctagaggccactgatatcagatartcggggaacaaacatgacctatagcgagagagggatcccaggctgggatcttaatgcagccagatgcatgaggtcccaagtactcaggctcctgcggagc

SEQ ID NO: 3155 - DNA, 201 bp, Homo sapiens
tctttctgcagccatgtttgaaaattaactttcaggctacagagtctttcttataccaaagttgaagaaagttttaagaaatatatttctacatctcctamatgcaaaacaacaggagcaagttgaggaattctcaagaaactggtcgagaagagagagcgcttagctatggaaaagagaaagaaggaagggagggcttcc

SEQ ID NO: 3156 - DNA, 201 bp, Homo sapiens
accaagtctttctgcagccatgtttgaaaattaactttcaggctacagagtctttcttataccaaagttgaagaaagttttaagaaatatatttctacatytcctacatgcaaaacaacaggagcaagttgaggaattctcaagaaactggtcgagaagagagagcgcttagctatggaaaagagaaagaaggaagggagg

SEQ ID NO: 3157 - DNA, 201 bp, Homo sapiens
gactaacacttgtcaggatcagaagctgaggtatctgcacccacattacaggaacaggatatgtgctcctagggaactgagggtgtcaggagatgaggaawgtccctggagtcacagaaagaaggtatcagatgtgtctcactctgacatatgcaggtgtttatgaaactctgggatttctaaggaaggatgcagtgcaga

SEQ ID NO: 3158 - DNA, 201 bp, Homo sapiens
acaaatacccagatatccaggtttggctcatgctacacgtccaaagtaagtcatccaggaagctctgcttatcatcgtactcaggaagccaggctgacagkctttctcctgcacatctgctcccagaacctccccagcagaatgaagggaacctaagaatttattcactggcttttaatgatccctcctagaaagaacaca

SEQ ID NO: 3159 - DNA, 201 bp, Homo sapiens
tgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacattta

SEQ ID NO: 3160 - DNA, 201 bp, Homo sapiens
aaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaataca

SEQ ID NO: 3161 - DNA, 201 bp, Homo sapiens
aggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatg

SEQ ID NO: 3162 - DNA, 201 bp, Homo sapiens
aaggaaggaaggaaggaaggaaggaaggaaggaaagaaggacaatctcaaattctatttcattatttttcttccacgctcctagtccagcctagggtgaaygtttccccctccaagaaggggcccttgcagcaccacaacctgcttgtctgccacgtgacggatttctacccaggcagcattcaagtccgatggttcctga

SEQ ID NO: 3163 - DNA, 201 bp, Homo sapiens
gcggcaggagctggaatgggagggggtgcatgaggctgagtgtggcgcatcctcctcggggctgagatggattttacttgtcttgggttccccacggctgkcacagggcagtgtctcagttcattcgtctttttccttcaggaagtctgggtgtaaagggatggagagaggtgaggtgtgtgcagtaagaggatttctcaa

SEQ ID NO: 3164 - DNA, 201 bp, Homo sapiens
tccagggagaggggacccagggggaagagcaaaggaccggatcctgggaactggacagttgtgatttggccaagacagaaaagcctgtgaaagagaccaawaaaacccaagtgcagtgtgaggagaggcccgcagagaagagtcttggaagctgaggggaggtgacctcagcagcacagtggacagcggtgccagtgactt

SEQ ID NO: 3165 - DNA, 201 bp, Homo sapiens
gaaacctacagggaggtagctgggtttgaggtgcttgaggggcagatgggtggtctgatgggcaggtagacagaagggtctgcagccggggaggagactgrgatacatgagaccatccagggagaggggacccagggggaagagcaaaggaccggatcctgggaactggacagttgtgatttggccaagacagaaaagcct

SEQ ID NO: 3166 - DNA, 201 bp, Homo sapiens
tggggtccactcatcttatcttctgcatctataccctggggccatgtccaaaccccatctttcttctataccagctcctgagcatagtttgaagccagggmaatggagacttcctgaccttggcttaggggttcctgaagattcatagttctcccccttgtcagagaatctagggacactgactggtctcgaaaccctcac

SEQ ID NO: 3167 - DNA, 201 bp, Homo sapiens
accataatttttctctcctggacttacaggaaggaggctggcaacctgggataacttgtcttttacccccacagggttcctgagctcactgaaaagactawtgtgccttaggaaaagcatttgctgtgtttcgttagcatctggctccaggacagaccttcaacttccaaattggatactgctgccaagaagttgctctga

SEQ ID NO: 3168 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgaggtgagtgagggctttgggccggcggtcccagggcagccccgcgggcccgtgcccagggcgcaggagcagccggg

SEQ ID NO: 3169 - DNA, 201 bp, Homo sapiens
agggacggcaggaatgctacgcgtttaatgggacacagcgcttcctggagagatacatctacaaccgggaggagttcgcgcgcttcgacagcgacgtgggrgagttccgggcggtgacggagctggggcggcctgctgcggagtactggaacagccagaaggacatcctggaggagaagcgggcagtgccggacaggatgt

SEQ ID NO: 3170 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgaggtgagtgagggctttgggccggcggtccc

SEQ ID NO: 3171 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgaggtgagtgagggctttgggccggcggtcccagggcagccccgcgggcccgtgcccagggcgcaggagcagccgggttg

SEQ ID NO: 3172 - DNA, 201 bp, Homo sapiens
tcttattcttgaatgaaaaacgttctcttactggtgattgaggaggagaaacaaagactaacaaatgaaaatgggagaatccacactcagagtggggcaaytgaacaggcaggggcggatggatggcagaggaggaggaatctggactcaaggagctggggggctctgggcctggaattttagggtctggggcccaaggca

SEQ ID NO: 3173 - DNA, 201 bp, Homo sapiens
cagggttcctgagctcactgaaaagactattgtgccttaggaaaagcatttgctgtgtttcgttagcatctggctccaggacagaccttcaacttccaaaktggatactgctgccaagaagttgctctgaagtcagtttctatcattctgctctttgattcaaagcactgtttctctcactgggcctccaaccatgttccc

SEQ ID NO: 3174 - DNA, 201 bp, Homo sapiens
agggttcctgagctcactgaaaagactattgtgccttaggaaaagcatttgctgtgtttcgttagcatctggctccaggacagaccttcaacttccaaatwggatactgctgccaagaagttgctctgaagtcagtttctatcattctgctctttgattcaaagcactgtttctctcactgggcctccaaccatgttccct

SEQ ID NO: 3175 - DNA, 201 bp, Homo sapiens
aggaggctggcaacctgggataacttgtcttttacccccacagggttcctgagctcactgaaaagactattgtgccttaggaaaagcatttgctgtgtttygttagcatctggctccaggacagaccttcaacttccaaattggatactgctgccaagaagttgctctgaagtcagtttctatcattctgctctttgattc

SEQ ID NO: 3176 - DNA, 201 bp, Homo sapiens
agcatttgctgtgtttcgttagcatctggctccaggacagaccttcaacttccaaattggatactgctgccaagaagttgctctgaagtcagtttctatcrttctgctctttgattcaaagcactgtttctctcactgggcctccaaccatgttcccttcttcttagcaccacaaataatcaaaacccaacatgactgttt

SEQ ID NO: 3177 - DNA, 201 bp, Homo sapiens
gctggcaacctgggataacttgtcttttacccccacagggttcctgagctcactgaaaagactattgtgccttaggaaaagcatttgctgtgtttcgttarcatctggctccaggacagaccttcaacttccaaattggatactgctgccaagaagttgctctgaagtcagtttctatcattctgctctttgattcaaagc

SEQ ID NO: 3178 - DNA, 201 bp, Homo sapiens
ttctatcattctgctctttgattcaaagcactgtttctctcactgggcctccaaccatgttcccttcttcttagcaccacaaataatcaaaacccaacatractgtttgttttcctttaaaaatatgcaccaaatcatctctcatcacttttctctgagggttttagtagacagtaggagttaataaagaagttcattttg

SEQ ID NO: 3179 - DNA, 201 bp, Homo sapiens
ctatcattctgctctttgattcaaagcactgtttctctcactgggcctccaaccatgttcccttcttcttagcaccacaaataatcaaaacccaacatgastgtttgttttcctttaaaaatatgcaccaaatcatctctcatcacttttctctgagggttttagtagacagtaggagttaataaagaagttcattttggt

SEQ ID NO: 3180 - DNA, 201 bp, Homo sapiens
agcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactgg

SEQ ID NO: 3181 - DNA, 201 bp, Homo sapiens
tctgctctttgattcaaagcactgtttctctcactgggcctccaaccatgttcccttcttcttagcaccacaaataatcaaaacccaacatgactgtttgytttcctttaaaaatatgcaccaaatcatctctcatcacttttctctgagggttttagtagacagtaggagttaataaagaagttcattttggtttaaaca

SEQ ID NO: 3182 - DNA, 201 bp, Homo sapiens
ggcaacctgggataacttgtcttttacccccacagggttcctgagctcactgaaaagactattgtgccttaggaaaagcatttgctgtgtttcgttagcayctggctccaggacagaccttcaacttccaaattggatactgctgccaagaagttgctctgaagtcagtttctatcattctgctctttgattcaaagcact

SEQ ID NO: 3183 - DNA, 201 bp, Homo sapiens
aggactgcaaagtaggtaccttagttttccactgacttccacttttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattacct

SEQ ID NO: 3184 - DNA, 201 bp, Homo sapiens
actgtttctctcactgggcctccaaccatgttcccttcttcttagcaccacaaataatcaaaacccaacatgactgtttgttttcctttaaaaatatgcaycaaatcatctctcatcacttttctctgagggttttagtagacagtaggagttaataaagaagttcattttggtttaaacataggaaagaagagaaccatg

SEQ ID NO: 3185 - DNA, 201 bp, Homo sapiens
cctgggataacttgtcttttacccccacagggttcctgagctcactgaaaagactattgtgccttaggaaaagcatttgctgtgtttcgttagcatctggytccaggacagaccttcaacttccaaattggatactgctgccaagaagttgctctgaagtcagtttctatcattctgctctttgattcaaagcactgtttc

SEQ ID NO: 3186 - DNA, 201 bp, Homo sapiens
ctctcactgggcctccaaccatgttcccttcttcttagcaccacaaataatcaaaacccaacatgactgtttgttttcctttaaaaatatgcaccaaatcrtctctcatcacttttctctgagggttttagtagacagtaggagttaataaagaagttcattttggtttaaacataggaaagaagagaaccatgaaaatgg

SEQ ID NO: 3187 - DNA, 201 bp, Homo sapiens
tcttttacccccacagggttcctgagctcactgaaaagactattgtgccttaggaaaagcatttgctgtgtttcgttagcatctggctccaggacagaccytcaacttccaaattggatactgctgccaagaagttgctctgaagtcagtttctatcattctgctctttgattcaaagcactgtttctctcactgggcctc

SEQ ID NO: 3188 - DNA, 201 bp, Homo sapiens
ggcctccaaccatgttcccttcttcttagcaccacaaataatcaaaacccaacatgactgtttgttttcctttaaaaatatgcaccaaatcatctctcatyacttttctctgagggttttagtagacagtaggagttaataaagaagttcattttggtttaaacataggaaagaagagaaccatgaaaatggggatatgtt

SEQ ID NO: 3189 - DNA, 201 bp, Homo sapiens
cagggtgagcgggacttaccttcccctggcatattcacacttattccacgatgaggggtttgacagaaaagaaatgtcagaaagctctagaggccactgawatcagataatcggggaacaaacatgacctatagcgagagagggatcccaggctgggatcttaatgcagccagatgcatgaggtcccaagtactcaggctc

SEQ ID NO: 3190 - DNA, 201 bp, Homo sapiens
cattgggtatcaggccttaactccagcgcaccctggaggtcactgatgtggctccaggctgacctgctcctgtcaaagaatattgagcaagatgcctctcrtggaatgttctgggaccttaaaacagatacccaagtattccccctgatttcatggttcccagaagctctatggggaagaaattgtaggtaattcacaact

SEQ ID NO: 3191 - DNA, 201 bp, Homo sapiens
tcttcatgcacaggaggagcaagaaaggtgagaaagcctgcagggtgagcgggacttaccttcccctggcatattcacacttattccacgatgaggggttwgacagaaaagaaatgtcagaaagctctagaggccactgatatcagataatcggggaacaaacatgacctatagcgagagagggatcccaggctgggatct

SEQ ID NO: 3192 - DNA, 201 bp, Homo sapiens
ggacaggatgtgcagacacaactacgagctgggcgggcccatgaccctgcagcgccgaggtgagtgagggctttgggccggcggtcccagggcagccccgygggcccgtgcccagggcgcaggagcagccgggttggcctaagggaccttagtgccgggcggaaaggggactttgggttggggattcatggggggagccca

SEQ ID NO: 3193 - DNA, 201 bp, Homo sapiens
atatatttctacatctcctacatgcaaaacaacaggagcaagttgaggaattctcaagaaactggtcgagaagagagagcgcttagctatggaaaagagaragaaggaagggagggcttcctggaggaggtggcatttgaaccaggactgacatcaggatggaaatgtcagtcagggagttaagtagggggagcagctccg

SEQ ID NO: 3194 - DNA, 201 bp, Homo sapiens
gcggaaacccagaggtcttaacagtagggttcgtagaaggtccaagggccagatcttgatgcccaacattgcttatgggagcaacaacaacaacaaaaaamacatgctgcccagtggcttccagaagtttctggtccacagcctcaaggagctgaaagtgctgctgatgtgcaacaaatcttactgtgctgagatcgctca

SEQ ID NO: 3195 - DNA, 201 bp, Homo sapiens
gatggtgaaagtggaaggaggtgggagttgggcattgggtgtgaagatgctctttaaaggggttttaataaccacttgctaccaggccagtgaacacttaycatagttgatgccttttgagcatgttgcattgtaaactgtccctgaaattcctgtgcacttggcttatgggatgaaacatcctcctagttctcttgtctc

SEQ ID NO: 3196 - DNA, 201 bp, Homo sapiens
ttactgtgctgagatcgctcacaaaatttcctccagaactgcaaagtcatcatggaaagagtcacccagccggccatcagagtcaccaaccccagtaccasggtgcacagctaagaaaatgagtagaaagttcatgtccacgttttgtgtgtaaataaaaccataaaaactgccaaaaaaaattacatcaatgcctctaaa

SEQ ID NO: 3197 - DNA, 201 bp, Homo sapiens
cagtaagaataggatcagctgtgctaaactaacaaatacccagatatccaggtttggctcatgctacacgtccaaagtaagtcatccaggaagctctgctyatcatcgtactcaggaagccaggctgacagtctttctcctgcacatctgctcccagaacctccccagcagaatgaagggaacctaagaatttattcactg

SEQ ID NO: 3198 - DNA, 201 bp, Homo sapiens
aaggtactgacatcatgtcacctcctcatctttcagggtagcaaggttggaatctcctgaatacagcccctcaagccctaaaacctcttatctattacctygggttcattgtccaggaaggggaggagaacttgaacttgtagtcacagaagggtgctgagaactaaccagcaggacggctcagccctgggaactgcagag

SEQ ID NO: 3199 - DNA, 201 bp, Homo sapiens
agcactggtgacactgaacagtgtcaggaggaagtgacggatgcagcgcccccatcccataggcagagctgtcatgtgggatgagggacagtgttgggagycaccaaggaaacccagaggtgggggagcagagagcagaagggggcatgtgatgctgggcagtgaaagggaggacaggcaaaggctgggttgaggtttgta

SEQ ID NO: 3200 - DNA, 201 bp, Homo sapiens
agacactgctcatggcactccctaggaagaacagcatgtgggaaaggctgccaaaattgttcatgtaaaaattacatcaatgctgtcttcctcggtgctgyctatgcagctggcagccatctcttcctccacatcatggcctccctcagactcctcatgaaggataagatcctcaaaaagaggaccaacaagttcatgagg

SEQ ID NO: 3201 - DNA, 201 bp, Homo sapiens
agtctcattgagcaccttctcttcaatttcttttacacagtaagaataggatcagctgtgctaaactaacaaatacccagatatccaggtttggctcatgytacacgtccaaagtaagtcatccaggaagctctgcttatcatcgtactcaggaagccaggctgacagtctttctcctgcacatctgctcccagaacctcc

SEQ ID NO: 3202 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgaggtgagtgagggctttgggccggcggtcccagggcagccccgcgggcccgtgcccagggcgcaggagcagccgggttggc

SEQ ID NO: 3203 - DNA, 201 bp, Homo sapiens
ttacccccacagggttcctgagctcactgaaaagactattgtgccttaggaaaagcatttgctgtgtttcgttagcatctggctccaggacagaccttcarcttccaaattggatactgctgccaagaagttgctctgaagtcagtttctatcattctgctctttgattcaaagcactgtttctctcactgggcctccaac

SEQ ID NO: 3204 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggtgagtgagggctttgggccggcggtcccagggcagccccgcgggcccgtgcccagggcgcaggagcagccgggttggccta

SEQ ID NO: 3205 - DNA, 201 bp, Homo sapiens
ccacagggttcctgagctcactgaaaagactattgtgccttaggaaaagcatttgctgtgtttcgttagcatctggctccaggacagaccttcaacttccmaattggatactgctgccaagaagttgctctgaagtcagtttctatcattctgctctttgattcaaagcactgtttctctcactgggcctccaaccatgtt

SEQ ID NO: 3206 - DNA, 201 bp, Homo sapiens
aaggtatcagatgtgtctcactctgacatatgcaggtgtttatgaaactctgggatttctaaggaaggatgcagtgcagagacaggtcccagaggagacargagctgagagaccatccaaactgggaccaccttgtcactagacttcaaattttcaatattgatagagtgttttctaagagtcaggccctttgctgagtgc

SEQ ID NO: 3207 - DNA, 201 bp, Homo sapiens
aggagaagcgggcagtgccggacaggatgtgcagacacaactacgagctgggcgggcccatgaccctgcagcgccgaggtgagtgagggctttgggccggsggtcccagggcagccccgcgggcccgtgcccagggcgcaggagcagccgggttggcctaagggaccttagtgccgggcggaaaggggactttgggttggg

SEQ ID NO: 3208 - DNA, 201 bp, Homo sapiens
aggttggttcatttatatttccagagccagctaagaatagtacaggagaacaggattgtggactaattttagccatgtcactgaatccaacagtacattayaaaaacaatacgttttgaccaattttagatttattctaggaatgcaatgattcttcagtgtcagaaaatatataatgtggttaacacattagtggactcc

SEQ ID NO: 3209 - DNA, 201 bp, Homo sapiens
ttccctttcgtgtaaaatggtgctgttattactctgtcttgaaataggaaggtgggatttctggggaggctggtgaaggagggcagggttcttttctctaygtgtcatgttaaaattgccaaataaagtacctctgcctgtgatattttctggatgtcctttatttactgtgacgtgtgtttgggtgccttgtttaggggt

SEQ ID NO: 3210 - DNA, 201 bp, Homo sapiens
tcagaggcctcttgtggctttccacaacttattgtctcatatttttatggacagtttatacaggcaccccacaagtccttttcccaacatgcccccctccstttttttttttttaaccgctattgctattatggcttatttgtggtgtttggtctgttttcagaagtgtcttttgcatctgtagactaaaagtaaacagca

SEQ ID NO: 3211 - DNA, 201 bp, Homo sapiens
gcccatggaattatcttcactgaggactacaggaccagagtatgtgactgtgtgcgtcaggggtgctggggggagggcacaggttgggggagacagggaasttgggaaacagaaataaaaacaaaagaaagaatttccctgcccccacatcccatggagagggcacagggccctggtaaatagtaatatgagggagagaga

SEQ ID NO: 3212 - DNA, 201 bp, Homo sapiens
gggggaggaggaggaaggaaggagggggaggaggagggggggaggaagagggggaggaggatgaagaggaggaggaagaagaagggtatgagaggtggaargatctgagcaagaggtaagacaggaagagaaatgctgtcctgggggtggaggttggtagagagtgagggtggggatggaccatgtctctcatctctgctt

SEQ ID NO: 3213 - DNA, 201 bp, Homo sapiens
aagaagagggaagaggtaaagtaaaatataaactgaaatctaggctgagtgtggtggctcatgcctgtactcccaccactttgggagactgaggcaggagwatagcttgaaaccaaaagtttgagaccagcctgggcaacaaagtgagaccccatctttactaaataactgagatcccatctctactaaataaataaatta

SEQ ID NO: 3214 - DNA, 201 bp, Homo sapiens
atgtggtgggagccatggcgcagtctgcctaggcagtggcaggagcgcagaagactctgattcctctcctcggtcctaagaccgaatgtgtgtcaggacakgtggtcagggaagagaagctatttaactgaaccagtaatagtagcaggaaaagaaaaagtggagggagggcagtccaggtagggggcctggaacaagcaa

SEQ ID NO: 3215 - DNA, 201 bp, Homo sapiens
ggtggctcacacctgtaatcccagcactttgggaggccgaggtgggtggatctcttgagctcatgagtttgataccagcatgggcaacatgacataacccmatctctacaaaaaatacaaaaattagccaggcgtggtggtacgcgcctatagagctactggggaggctgaggtgggaggattgcttgagctggggaggcg

SEQ ID NO: 3216 - DNA, 201 bp, Homo sapiens; identical to SEQ ID NO: 682

SEQ ID NO: 3217 - DNA, 201 bp, Homo sapiens
tggctcacacctgtaatcccagcactttgggaggccgaggtgggtggatctcttgagctcatgagtttgataccagcatgggcaacatgacataaccccakctctacaaaaaatacaaaaattagccaggcgtggtggtacgcgcctatagagctactggggaggctgaggtgggaggattgcttgagctggggaggcgga

SEQ ID NO: 3218 - DNA, 201 bp, Homo sapiens
cagacgtcagatcatgacaggccttgtacatcagtgttgtttccatcttacactgaggcgatgggctggtagagaatatcatagagagagggaatggtgtrttggagatagtggatgaggcagggaggtcagctaagaagatactgcatctgagaagtggtgaaggcctaaattaggtcagtgcagtagggagggagagga

SEQ ID NO: 3219 - DNA, 201 bp, Homo sapiens
aagccgagatcccgccactgcactccagcctgggcaccattgagcactgagtgaaccagacaccgtctgcaatcgcggcacctccggaggccgaggctggyggatcactcgcggttaggagctggagaccagcccggccaacacagcgaaaccccgtctccactaacaaaatacgaaaaccagtcaggcgtggcggcgcgc

SEQ ID NO: 3220 - DNA, 201 bp, Homo sapiens
tggctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggtt

SEQ ID NO: 3221 - DNA, 201 bp, Homo sapiens
gagcagggggagatcagaatcgtccagctgggcttcgacttggatgcccatggaattatcttcactgaggactacaggaccagagtatgtgactgtgtgcrtcaggggtgctggggggagggcacaggttgggggagacagggaagttgggaaacagaaataaaaacaaaagaaagaatttccctgcccccacatcccatg

SEQ ID NO: 3222 - DNA, 201 bp, Homo sapiens; identical to SEQ ID NO: 686

SEQ ID NO: 3223 - DNA, 201 bp, Homo sapiens
gcatctggtgcttccctgcctccctccagttccatccagcctgtcctcctgtttttttggtgaacctgccagaaaagctgccaaaaagctgactcttcttkttaataaaatgacccaagtttgtattcctccccacaagagaggaggcctatcttacctgggccttagaaagagccctgaaatagaattcagttcttggtg

SEQ ID NO: 3224 - DNA, 201 bp, Homo sapiens
gagattcatcaagtactttgttaaaggtatcccatctgcagctcaagcctgcagcccctcaccttttggtggctcctcaggcctctaggccttattcacckttcccctttcctgtgccacttctcctctagggcgccaggctgtccttagcatggtccggaaggcaaagtaccgggaactgctcctatcagagctcctggg

SEQ ID NO: 3225 - DNA, 201 bp, Homo sapiens
tcaagtactttgttaaaggtatcccatctgcagctcaagcctgcagcccctcaccttttggtggctcctcaggcctctaggccttattcacctttcccctytcctgtgccacttctcctctagggcgccaggctgtccttagcatggtccggaaggcaaagtaccgggaactgctcctatcagagctcctgggccggcggg

SEQ ID NO: 3226 - DNA, 201 bp, Homo sapiens
ctgcagcccctcaccttttggtggctcctcaggcctctaggccttattcacctttcccctttcctgtgccacttctcctctagggcgccaggctgtccttrgcatggtccggaaggcaaagtaccgggaactgctcctatcagagctcctgggccggcgggcgcctgtcgtggtgcggcttggcctcacctaccatgtgca

SEQ ID NO: 3227 - DNA, 201 bp, Homo sapiens
cgaatgtgtgtcaggacatgtggtcagggaagagaagctatttaactgaaccagtaatagtagcaggaaaagaaaaagtggagggagggcagtccaggtarggggcctggaacaagcaactgcaccaacagaggcagttggtgcgagcacagaaccaccccaggctgggattttgttatccagtctctcttgcatggttgc

SEQ ID NO: 3228 - DNA, 201 bp, Homo sapiens
gtgatttctaacctttttgtaatctttagaaggtgataaaagctatggctatctctctccagaaaaatgcacgtttgccacatatacatagggtgtatgtrtagttaggggggaaatattttactaatcctgcgaggtccgtggttaaggactccaggtttagagtggaagttaatagggtcaaatccacaatgctgggaa

SEQ ID NO: 3229 - DNA, 201 bp, Homo sapiens
caggcctctaggccttattcacctttcccctttcctgtgccacttctcctctagggcgccaggctgtccttagcatggtccggaaggcaaagtaccgggarctgctcctatcagagctcctgggccggcgggcgcctgtcgtggtgcggcttggcctcacctaccatgtgcacgacctcattggggcccagctagtggact

SEQ ID NO: 3230 - DNA, 201 bp, Homo sapiens
aggaagagtgggtagaggagtgatttctaacctttttgtaatctttagaaggtgataaaagctatggctatctctctccagaaaaatgcacgtttgccacrtatacatagggtgtatgtatagttaggggggaaatattttactaatcctgcgaggtccgtggttaaggactccaggtttagagtggaagttaatagggtc

SEQ ID NO: 3231 - DNA, 201 bp, Homo sapiens
tgttctagctgtttgggaagttgaggcagaaggagtgcttgagcccaggaatttgaggctgcagtgagctatgattgcacgactgcactccaggctgggtracagagggagaccctgtctctaaaaaaatgaaaacaacaacaaaaaaacccagaactgaaatctgtccattggatttagcaggtagaaggttaatagtga

SEQ ID NO: 3232 - DNA, 201 bp, Homo sapiens
tcctgtgccacttctcctctagggcgccaggctgtccttagcatggtccggaaggcaaagtaccgggaactgctcctatcagagctcctgggccggcgggygcctgtcgtggtgcggcttggcctcacctaccatgtgcacgacctcattggggcccagctagtggactggtgagtctttccctggcctctggcagattat

SEQ ID NO: 3233 - DNA, 201 bp, Homo sapiens
gaagttaatagggtcaaatccacaatgctgggaaacaccatcatttaaggcagtgttactgaatatatgagctgagttattatgcctgtgtcaaaattacrtgggctgcttgttaaaaaaaatacaggttcctgggactcatccaaggttaatgaattacgctctcttggggcgggatttgggactctacatttttgaact

SEQ ID NO: 3234 - DNA, 201 bp, Homo sapiens
tggagttcagtggcatgatcttggcttactgcaagctctgcctcctgggttcacccattctcccgcctcagcctcccgagtagctgggactacaggtgccygccactatgcctggctaattgtttttttttttgtatttttagtagagatggggtttcaccgtgttagccaggatggtcttgatctccggacctcgtgatc

SEQ ID NO: 3235 - DNA, 201 bp, Homo sapiens
ggctgcttggtcatttgcttgattattttctcacacagtttttcctttactaagagaaaatgcccccatattggcaaacaaaatctccctgcctgagagcrcccagagtatagcagagcatcttaccctgatacgcctcttttcactctcttctctgtggagacagaaggagcttcaagagcagggggagatcagaatcgt

SEQ ID NO: 3236 - DNA, 201 bp, Homo sapiens
ttaatgaattacgctctcttggggcgggatttgggactctacatttttgaactgcctcaagtgctttttaagtgtgccttaaaatttgagatccactgacrtaaagggaaagcagaagaagaggaatctgtgacagaggcagagagggacttgcctgagttaagaggaacccagaggccggcgcggtggctcacacctgta

SEQ ID NO: 3237 - DNA, 201 bp, Homo sapiens
acaagagaggaggcctatcttacctgggccttagaaagagccctgaaatagaattcagttcttggtggcttatcaaaagcacacaggggcctggcaggaastgtaaaagcttgatgttaatcatactgggactaagaggatagagaatggtaggagctgggatacccctaaacattcacattaaaacaaaaaaaacccaaa

SEQ ID NO: 3238 - DNA, 201 bp, Homo sapiens
ccactcccagttcggtaccgggtctttgctctggatcagaagatgcgcccgagcactgacaccatcacagtcatggtggaggtgagtccccgacctctggmcttcctgatcctggccactgatgtgacctcctgcctgtgagcacttctccccttgcagaactctcacggcctccgcgtgcggaagaaggaggtgtacatg

SEQ ID NO: 3239 - DNA, 201 bp, Homo sapiens
ggctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggttc

SEQ ID NO: 3240 - DNA, 201 bp, Homo sapiens
ctctcaaaggcagagttccaggacgccctggagaagctgaatatgggcattactgacctccaggggctgcgcctctacgttgctgcagccatcattgagtmtccaggtgggtgactttcccttattgtaaccccagacccttgcctctgacctctgagctaaccctctgtcctccggcaccaacaccaccccacttctcac

SEQ ID NO: 3241 - DNA, 201 bp, Homo sapiens
gctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggttca

SEQ ID NO: 3242 - DNA, 201 bp, Homo sapiens
ctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggttcac

SEQ ID NO: 3243 - DNA, 201 bp, Homo sapiens
cccggagacctttggagttaagaggcggcggaagcgagggcctgtggagtcggatcctcttcggggtgagccaggtaaccatggcaaccccgggggtgggkcctcgcttccggtagccgagagttttgttagaaccgcgtccccgccccagttccctgtccgtgagccgatttatctgcccagggtcggcgcgcgcggctg

SEQ ID NO: 3244 - DNA, 201 bp, Homo sapiens
attgccaaataaagtacctctgcctgtgatattttctggatgtcctttatttactgtgacgtgtgtttgggtgccttgtttaggggtagaggtgaagtctragctttgcctcattcagagaggaaaggggtcaggggttcactctgacgttcaggccattctccctgtggagtggtgagggtgtacctaatctcctaaacc

SEQ ID NO: 3245 - DNA, 201 bp, Homo sapiens
gggggaggaagagggggaggaggatgaagaggaggaggaagaagaagggtatgagaggtggaaggatctgagcaagaggtaagacaggaagagaaatgctktcctgggggtggaggttggtagagagtgagggtggggatggaccatgtctctcatctctgcttgtaggtcctcaaggcctgtgatggccgaccgtatgct

SEQ ID NO: 3246 - DNA, 201 bp, Homo sapiens
taagaccgaatgtgtgtcaggacatgtggtcagggaagagaagctatttaactgaaccagtaatagtagcaggaaaagaaaaagtggagggagggcagtcmaggtagggggcctggaacaagcaactgcaccaacagaggcagttggtgcgagcacagaaccaccccaggctgggattttgttatccagtctctcttgcat

SEQ ID NO: 3247 - DNA, 201 bp, Homo sapiens
tgaatggacagagccacatttccctctcaaaggcagagttccaggacgccctggagaagctgaatatgggcattactgacctccaggggctgcgcctctaygttgctgcagccatcattgagtctccaggtgggtgactttcccttattgtaaccccagacccttgcctctgacctctgagctaaccctctgtcctccggc

SEQ ID NO: 3248 - DNA, 201 bp, Homo sapiens
gagaggctgaggacagctatcctaatcaaaagtcataatccattgcccttttccagatctgagctgttcttagacccagaatttcttgcctgaaggaggartcaggtccccacaaggaaagaccctgcaactgtataaaaaaagaatctaaaaagatcatgactccttcagtcctttcccaaagagacctatggaaatttc

SEQ ID NO: 3249 - DNA, 201 bp, Homo sapiens
cacggtggcatatgcctgtagtcccagctacttgggaggctgaggcaggagaatccttgaacctaggaggcagaggctgcagtgagccaagattgtgccamtgcactccagcctggtcaacacagcaagactctgtctcaaaaaaaaaagagaggtcctccccccatctcaggtctttgatattctaatgatgaatgtttt

SEQ ID NO: 3250 - DNA, 201 bp, Homo sapiens
cttagctgtagacaaacatcctgcagtttaccaaatatgatgcagtcttctcagggaagatatctaccaaaaaatgaatgaccaccatttaattaacctargtgtgtttgtgttttattttttaccatcttccaccaattatgattcttgaatattcccctgattgaaatggcaatactggttaaatgaaaatagtagctt

SEQ ID NO: 3251 - DNA, 201 bp, Homo sapiens
ccctcacagtgaaagatcaacaactttccccacaacatacctttaaaacatagagtgggtacttctcaaatgaggatccaatgtggatttttgtaagcatrtcaggatgcctctcagttataaattctatccaagaatagatctagcaaaatggaaaccagaggttagtcacgaagccaagttcaaagcatttccctgacc

SEQ ID NO: 3252 - DNA, 201 bp, Homo sapiens
caacttttgcaatcaaatttttatgaaatgaaattttcttgtgattttgattttcattttctgacttattaatgaagtacagttgtttatatttgattatyggccattcatatttttgcttatatgttatgtttattcagatcaactgcccatttttttctaatttacttgtatttttgtagtagttaatttgtataattt

SEQ ID NO: 3253 - DNA, 201 bp, Homo sapiens
aactcaagttttaacaaacacgactggagaattaatccctcccctcacagtgaaagatcaacaactttccccacaacatacctttaaaacatagagtgggwacttctcaaatgaggatccaatgtggatttttgtaagcatatcaggatgcctctcagttataaattctatccaagaatagatctagcaaaatggaaacca

SEQ ID NO: 3254 - DNA, 201 bp, Homo sapiens
cacacatggtaatataaacatttattttgcagtgagttttttaaaattcctttctataactctagttgctaaaaaaaaataaaataaaagggcctggaatrtacaagataatccataaatatttgatgagacaatgatgaatgaatgactatattcatggcttaactgtaaaattgcatgtgtacatcagatatttgaaag

SEQ ID NO: 3255 - DNA, 201 bp, Homo sapiens
ggaaacaaactcaagttttaacaaacacgactggagaattaatccctcccctcacagtgaaagatcaacaactttccccacaacatacctttaaaacatasagtgggtacttctcaaatgaggatccaatgtggatttttgtaagcatatcaggatgcctctcagttataaattctatccaagaatagatctagcaaaatg

SEQ ID NO: 3256 - DNA, 201 bp, Homo sapiens
tccctgagtctgggtacagagtcagagaaaaaggaactatgagagcctttaccaatcactgagtctaacctgcattttagataagggacggaggtcatgargggttgaaccatttatccaagatcacagagctggaccttaggctttatcaccagtccatttggtccagtcagagacttctatgctgccatggttaataca

SEQ ID NO: 3257 - DNA, 201 bp, Homo sapiens
gagctggaatgagaggctatgtttgtcgtttttgacacccctcccctttctgggccatcgcctaattaccgtggagcaaacggaatgcatggttgtatttytaaaggcacaagcagaaatttattgaaaatttggagcagaaatctttaatgtacttctgaccacccttccttttgttgagtaggatccaatgatcagcgt

SEQ ID NO: 3258 - DNA, 201 bp, Homo sapiens
taaaaaccaccgtttcccaccattaccaacattactcaatggtgattcttcagtgtcttttatatgaatatatggattaatgtacctttgttcaatccagrctaacactgtattatgctgttttcagttaaagaggaagaagaagcagaaaagccttttctttctttttttttttttcttattttttcccccattgacctg

SEQ ID NO: 3259 - DNA, 201 bp, Homo sapiens
tgagaggctatgtttgtcgtttttgacacccctcccctttctgggccatcgcctaattaccgtggagcaaacggaatgcatggttgtatttctaaaggcasaagcagaaatttattgaaaatttggagcagaaatctttaatgtacttctgaccacccttccttttgttgagtaggatccaatgatcagcgtgagatgatc

SEQ ID NO: 3260 - DNA, 201 bp, Homo sapiens
tgggaggccgaggcaggtgcatcacaagggcaggagtttgagaccagcctggccaatatggtgaaaccctgtctctactaaaaatacaaaaagcttagccrggcatggtggcaggcacccgtagtcccagtggctcaggaggctgaggcagaaaaatctcttgaacccgggaggtggaggttgcagtgagccgagatcgtg

SEQ ID NO: 3261 - DNA, 201 bp, Homo sapiens
aggctatgtttgtcgtttttgacacccctcccctttctgggccatcgcctaattaccgtggagcaaacggaatgcatggttgtatttctaaaggcacaagmagaaatttattgaaaatttggagcagaaatctttaatgtacttctgaccacccttccttttgttgagtaggatccaatgatcagcgtgagatgatcattg

SEQ ID NO: 3262 - DNA, 201 bp, Homo sapiens; identical to SEQ ID NO: 702

SEQ ID NO: 3263 - DNA, 201 bp, Homo sapiens
tttgatagattataatttgcatcacttgagatggtaggctgccttccaacacttctccccctgtccctaattcacaaggtgaagccccagcaagctgcatstgacacaagagattattccttcctgcaaacagttgagggctcaggatagggtctgactcttgtgcttgccaatctgaatcccttcaaagataacttgaaa

SEQ ID NO: 3264 - DNA, 201 bp, Homo sapiens
acacttctccccctgtccctaattcacaaggtgaagccccagcaagctgcatgtgacacaagagattattccttcctgcaaacagttgagggctcaggatwgggtctgactcttgtgcttgccaatctgaatcccttcaaagataacttgaaatcaatactaagagtctagtctcagtctagctgctctcttgaacagaca

SEQ ID NO: 3265 - DNA, 201 bp, Homo sapiens
tgtgaacatcaccctttcagtgaagagacattgcaagaaataaagccaacaacctaccacaccagtgtttggaagcaaagttcctattcaggtctgttccratgcaatgattgttcgcatagaaagaacggttctttctccacattcgattctacataaacaaaatacaaacagacaacctgggtagccacgttcaaggcc

SEQ ID NO: 3266 - DNA, 201 bp, Homo sapiens; identical to SEQ ID NO: 701

SEQ ID NO: 3267 - DNA, 201 bp, Homo sapiens
acataaggtttctgagccatggccatgtgtatacctggtatttttactagttttctcaatagcacgaactgcttcactggctactagagactggaagcaamaagatatagaatttcagttaatgtgcagctttgaaacatgacaagtagaagtttctaaaaaataatcatacattaattgaatcaaagtatacaggtagaa

SEQ ID NO: 3268 - DNA, 201 bp, Homo sapiens
ttagcaaatcctgataatgggaaactcttttctttgacaaataaattgcaaggaaaaaaagaagagagagaaagagcaaaagatggaatgtgagttcatgsattaaaatagaattaaaagacatataaaccaatcataatgtaagagccttatttggatccagaatcaaagaaacatactttttaaaaagttaggaggccg

SEQ ID NO: 3269 - DNA, 201 bp, Homo sapiens
cagatttctttagtagctcaaagttctctaagatcataagaagaaatacttacataaggtttctgagccatggccatgtgtatacctggtatttttactarttttctcaatagcacgaactgcttcactggctactagagactggaagcaaaaagatatagaatttcagttaatgtgcagctttgaaacatgacaagtaga

SEQ ID NO: 3270 - DNA, 201 bp, Homo sapiens
gaaatttattgaaaatttggagcagaaatctttaatgtacttctgaccacccttccttttgttgagtaggatccaatgatcagcgtgagatgatcattgabtaaacttgcttgagatggctagtcaaacgtcgaaagttgcttgagatggctagtcaaacgtcgaaaatcaaagaaaaagtaggtaactagacttttacaa

SEQ ID NO: 3271 - DNA, 201 bp, Homo sapiens
ttctatgaataattcaacctgtatatcctatatccccaaggagaacatgatttgtcttctttgccttttctcctacctttttccatgagtagtcataaccrtccacattaaccaccggcataacatagaaatccacaagcctcaggagattggtatattgccctattatcccatagaattgagttatctgcaaattaaacc

SEQ ID NO: 3272 - DNA, 201 bp, Homo sapiens
cattccaactctttcctgaacatatcgtaagaaaacataacttttttgaacaaaataattaaaatatgttttaacaaatatttaaaaatacttctgtttayggcattcccctctccccaccaaacttatcacagcagtgacagtttcaccttctatgaaggtgaaatcccacctatgaagcctctctgcatcaagtttgct

SEQ ID NO: 3273 - DNA, 201 bp, Homo sapiens
gttttaagttcttctaaacttagtgtgtttctttttcttttttttaatttgtcatttggcatgtttagatttgcagatttaactttcagaaagagtgctarttcctcaaaagaactgaacttagggtgctacgaagtggtgataaatgccttacacgtggtccagtattcctagttaatgaaggcagacaatcgaaccata

SEQ ID NO: 3274 - DNA, 201 bp, Homo sapiens
ctgggattcatctagaattgaagccttaaccccctagagactgtatttggagatagggcctttaaagaggtgattaagttaacatgaggcccttagggtgkgtactaatccagactgactggtgtccttgtgggaggagattaggacatacagaccaggacaagactatattattaatgggaaaaataaccaacccctaaa

SEQ ID NO: 3275 - DNA, 201 bp, Homo sapiens
aaggcacgttctttatattcccttagagaacactgacccagggtgactctcaacaggatcacaccatgatttaaaacatctatcatttgccttctagaggmcaaaatttttcccagtttttgattcttcaactaagtattattttatttccaaaatgctaatgagaaaaataattaagtagcacttaccagttcctcatgg

SEQ ID NO: 3276 - DNA, 201 bp, Homo sapiens
aaactaaaaatggaactaccatataagccagcagtcctattattgggtatgtatccaaaagaaaggaaatcagtatatcaaaaagatacctgcactcccaygtttattacagcaccattcacaatagtcaagatatagaatcaacctaagtgttcttcaacagatgaatggataaagaaaatgtggatgtggataaagaaa

SEQ ID NO: 3277 - DNA, 201 bp, Homo sapiens
gtgagaaatgagagaagacaggaaattaagaagttacattgctagatggcttcttctaacattccttgttgctgtccatggccacattctgggtctaaggwtcagcaaaacattacttctgagatccagaggatggctacaggagaaatctgctaaagaggagttgagatgaggtttagtagaacagagaacaaggaactg

SEQ ID NO: 3278 - DNA, 201 bp, Homo sapiens
gtacttctgaccacccttccttttgttgagtaggatccaatgatcagcgtgagatgatcattgattaaacttgcttgagatggctagtcaaacgtcgaaasttgcttgagatggctagtcaaacgtcgaaaatcaaagaaaaagtaggtaactagacttttacaattttttttaaagggtaaaaagacatgaaccctagtc

SEQ ID NO: 3279 - DNA, 201 bp, Homo sapiens
tatttgaaaggaaacaaaattttttctagaaagaaagttgattaaacattgattttatttaataaaaatttcatgttcttgtaattatcatcatgtcattkttcctttttttaaaaaggcttccaataagatttacattttttctctcttaatgtgctttttatttatttatttatttattttttattttttatttttttt

SEQ ID NO: 3280 - DNA, 201 bp, Homo sapiens
agtctgccttaatggcaaagtagcacttattaggttctctgacagaaccaaggaataggaaaatcttttatcaaaactacggataaaacttaaaaataatytgatacaatgatttggtcttgctggaatcagtaaattaaaatacggaagcagaatgataaaatcaggggcattaaacattcctaatgacatgccaagcta

SEQ ID NO: 3281 - DNA, 201 bp, Homo sapiens
tgtggctatgttcactgacctttactaaggtcaatttattcaagagagaagacatccaatccaagttaggttaatcaatttctcttgcataatattttgcractgaaaataaataaccaaatgggtggaaattggagtagaaaccatcataagaaccctactgcaaaggacttcagccttgtccggctgtttgtccctcgc

SEQ ID NO: 3282 - DNA, 201 bp, Homo sapiens
aagaaacaagctactacctaaaaattagtcccttcccaagaatggggctgttgatgtaacacttccactgtctggagagcatctgggatgaggatttgtcraagcctagctacaatccttcaagaatccttgcatcttttgccatgaacccaaacatacagtatcttggactaaaaagtgctaagggagtatcaaattgtg

SEQ ID NO: 3283 - DNA, 201 bp, Homo sapiens
tatgtcaatggctcagcgctgagtaactgtcagctctatttacttagattctttttacatggctgctgttcctgtgagcccctggcatgttattagtgccrcagcaaactttgggcctctgggaacacgagtggttttttagggagaaaccactaaatgattccctggaacctaagtcgggatgaactgcttcttcctctg

SEQ ID NO: 3284 - DNA, 201 bp, Homo sapiens
gataagtatgttccaaggactacacacaacatggctgaaagcaaatgtcatgggtggatatgccatgatacatggatccaatctgattgaccaactcagtraccaaggggacccaacatttcatatgtctgccttgagtctgcactgtaagttcttgtaaacgacagattaaaattgagaagtcctaacccaaagtcttat

SEQ ID NO: 3285 - DNA, 201 bp, Homo sapiens
ctcaggggcctcatctgtaccaggaaggaacttgggccactggatccctccaagctcaagcattctttgatctatagacatggaaccaagcacactgtgaratatctataataggcaaattcatagagacagaaagtagataagaaattaccaagggctggggagaaggtagggatgaggagatattgcctactggttaca

SEQ ID NO: 3286 - DNA, 201 bp, Homo sapiens
tgtgctcctatgagaatctaacgctgccactgatctgacaggaagcattgctcaggcagtaatgcttgctcgctggctattcatctccagttgcgtggcckcgttcctaacaggccatggactggtacctgtctgcagcccaggggttgaggaccactggtatagagggaagggagaagactgttgtaaaatcaaacaaat

SEQ ID NO: 3287 - DNA, 201 bp, Homo sapiens
cagataagtatgttccaaggactacacacaacatggctgaaagcaaatgtcatgggtggatatgccatgatacatggatccaatctgattgaccaactcartgaccaaggggacccaacatttcatatgtctgccttgagtctgcactgtaagttcttgtaaacgacagattaaaattgagaagtcctaacccaaagtctt

SEQ ID NO: 3288 - DNA, 201 bp, Homo sapiens
ataagaaaaagaaagagttagatatttagattgtcatttgaaccactccaggaggttttttcctaacttggagctagcaatatttaacaggatagtaagtragaaagcccaatggcattggccactaatcgtcaaattgtatagtcaaagagaactacctagcttaatctactcaatgcaaagaaaatcttaagttgtctg

SEQ ID NO: 3289 - DNA, 201 bp, Homo sapiens
cctttctaagtcctgggccaattttcttggcactggttctgacaccgaaaagttggcaaaatcccagagactcacattatctgcacatccttgatcaagtragagtaggaccaaaccatccagaatgcatgatttttcaacgtgtacaggttccagataagtatgttccaaggactacacacaacatggctgaaagcaaat

SEQ ID NO: 3290 - DNA, 201 bp, Homo sapiens
gtggagaaatgtatgaaaggatgatcacaaacatgttcatattttcaccaggatggtgaaattttagtattttctccctaattttatgcttttctgtattrtttactttttaaacccaaaagaactcctattcttgtatttattcaagaaaattaaatttaaagaaaaatctcctttgactgtgaaaaagccactaacaag

SEQ ID NO: 3291 - DNA, 201 bp, Homo sapiens
gcccaatggcattggccactaatcgtcaaattgtatagtcaaagagaactacctagcttaatctactcaatgcaaagaaaatcttaagttgtctggattcrttactttacttgacctttctaagtcctgggccaattttcttggcactggttctgacaccgaaaagttggcaaaatcccagagactcacattatctgcaca

SEQ ID NO: 3292 - DNA, 201 bp, Homo sapiens
aaataattaaaatatgttttaacaaatatttaaaaatacttctgtttatggcattcccctctccccaccaaacttatcacagcagtgacagtttcaccttrtatgaaggtgaaatcccacctatgaagcctctctgcatcaagtttgctcatgcagtcgtgctgatggatgctggagagaggtggtctaagttggatagat

SEQ ID NO: 3293 - DNA, 201 bp, Homo sapiens
agcccaatggcattggccactaatcgtcaaattgtatagtcaaagagaactacctagcttaatctactcaatgcaaagaaaatcttaagttgtctggattmattactttacttgacctttctaagtcctgggccaattttcttggcactggttctgacaccgaaaagttggcaaaatcccagagactcacattatctgcac

SEQ ID NO: 3294 - DNA, 201 bp, Homo sapiens
cactaacaagcttctcagtgatgctggtaaccctctcatctcaccagcacattccttattattttcataaacagaatgttctctgggcccttggagtagcrtagtcacccagtgggttttctagccttacatagcatttttattctagtgtgctctatctcttttttcaccatctgccacattcgctctgacatttctagc

SEQ ID NO: 3295 - DNA, 201 bp, Homo sapiens
tcattttgtctgttgatattcattttgtcaaatctattctgaagttctcacttatctggaacttttcggaaattggaactagcatcatggtatacactgtyaccttcttgaaaaactcaagagatttatcagcggatattattttatgccatctcattgttcaaaaaataagttttaatgtaaccccattgtctacataat

SEQ ID NO: 3296 - DNA, 201 bp, Homo sapiens
catatgaatttctttttctgcttcactttttaaatttccttcctacctttacctctggttggatgggaatctttctacaaaaagttatgctctgagagatkaccgatgttaggcccagaacaatgttacctatttctttatctaataggtaggactccagacagaaggagtgagtgagggctgaaatacagtctgtgctgt

SEQ ID NO: 3297 - DNA, 201 bp, Homo sapiens
ttatgctctgagagattaccgatgttaggcccagaacaatgttacctatttctttatctaataggtaggactccagacagaaggagtgagtgagggctgaratacagtctgtgctgtgtgccaagccacaccttcaagtgtggctatagctacaatcccgaaggaaggggtgcccattttttctttaacagcttattgaga

SEQ ID NO: 3298 - DNA, 201 bp, Homo sapiens
cagcttattgagatataatttacattccagaaattcaccattttaaagtgtgaaattcagcggtttttggtgtattcatagagttttgcaaccatcactartatctgatttttggaacatttcatcataaaaaatccccatgcctgtgcccattataactcactcccctttccctcctgccatttccccaagcctctgaca

SEQ ID NO: 3299 - DNA, 201 bp, Homo sapiens
aagtgtgaaattcagcggtttttggtgtattcatagagttttgcaaccatcactaatatctgatttttggaacatttcatcataaaaaatccccatgcctrtgcccattataactcactcccctttccctcctgccatttccccaagcctctgacaatcactaatgaactttctgtctctgtggatttgcccattctggac

SEQ ID NO: 3300 - DNA, 201 bp, Homo sapiens
acagtaaaaatagtaatactaccagctgacacctgtggagcacatgctgtacgtcaggaactctgctaagatttttgccacatctcatgtaattcttacascagccctatgaagtaaatactgtcattttaggagatgcaatctggatattcttggtggtaaccattcttcagaataagaggctatacagcatattgttaa

SEQ ID NO: 3301 - DNA, 201 bp, Homo sapiens
tgacgacaaataaatatttgttgaaggtacgatttaccaacatggcaagtaacataactgaaatcctgtcctactagagatggtctgcaatatacaatgayttcacttatgattttttgactttacaatagcgcaaaagcaatgcatattcagtagaaaccatacccatgccaccattccatttttcagttttagtgcagt

SEQ ID NO: 3302 - DNA, 201 bp, Homo sapiens
ctaagatttttgccacatctcatgtaattcttacagcagccctatgaagtaaatactgtcattttaggagatgcaatctggatattcttggtggtaaccaytcttcagaataagaggctatacagcatattgttaagcacccaattacttgattctaaatcttgactaccatttattagctatatggctttgggtaaattt

SEQ ID NO: 3303 - DNA, 201 bp, Homo sapiens
tttaagccacccaacctatggtatttggttatagcagcctgagaagacaaagacacccctacaacctaccctccactctcatctccaacacacacacacamaaaattttaatacagaggagcataaaatgagtaagtaggtttgatatgtcacttcctgttaataagtgaggtgtttttggatcctttatataaagaatca

SEQ ID NO: 3304 - DNA, 201 bp, Homo sapiens
ggtaaaagtaagacatctcgcattgtggtaaactggttgacaaaccctttcagtagagcctacatgggcactagagaaaaagtagctcctattaggtataytttcaggacctccataaaaaccaccgtttcccaccattaccaacattactcaatggtgattcttcagtgtcttttatatgaatatatggattaatgtacc

SEQ ID NO: 3305 - DNA, 201 bp, Homo sapiens
tagtcccagtggctcaggaggctgaggcagaaaaatctcttgaacccgggaggtggaggttgcagtgagccgagatcgtgccactgcactccagcctgggygacagagcaagacaccatctcaaaaaaaaaaaaaaaaaaaagttattatacaattgaaaatactggcaatattttatggtattcagaaacagctagtttt

SEQ ID NO: 3306 - DNA, 201 bp, Homo sapiens
agttccttacaattactttttatttggttttttttttttttttttagttaaaaacccatatgcttgctgcttctgtttctgtttttcactcttatgatacrtaacaatatagcaccatgcccaagaggggactgagacatttcttgatgacaataacagaatatattttgactacttggctatccaaattaaataacactg

SEQ ID NO: 3307 - DNA, 201 bp, Homo sapiens
tgaggcagaaaaatctcttgaacccgggaggtggaggttgcagtgagccgagatcgtgccactgcactccagcctgggtgacagagcaagacaccatctcaaaaaaaaaaaaaaaaaaaagttattatacaattgaaaatactggcaatattttatggtattcagaaacagctagtttttaaggtataattatactataat

SEQ ID NO: 3308 - DNA, 201 bp, Homo sapiens
tgagttaattattgttgaagctctatgatgggtagatagaagtttactacacaattatgtgcacttatatatatatttgacattttccacaataaaagttaaaaaaaaattaataataaagccattgtgcctagatccagaattctatgaataattcaacctgtatatcctatatccccaaggagaacatgatttgtcttc

SEQ ID NO: 3309 - DNA, 201 bp, Homo sapiens
ctggtgatactaagtgacattagttaaggtagcaaagctggtgtgaattgaaactgaagtttgaagccaggactctttgatttaaaactgtttttatcctccacaattatgcagtcatgtcagagctgcatgtggaagtttcaaagaagagaccagagaactaatgatttgggctgtatcttcatgcttcatttagaggta

SEQ ID NO: 3310 - DNA, 201 bp, Homo sapiens
atttagaggtaaatgggtgtgagttggatggcaatcttccccgggaggtgtggagacacacccggagcaaaaactccctcaagattttcctgagtgcatatttttttatgtggattatttctttatttcacacaaaaagaagcatacatctaacctctcacgaacttaccagcaaatccagggacagaggcttttttccca

SEQ ID NO: 3311 - DNA, 201 bp, Homo sapiens
aacctgtatatcctatatccccaaggagaacatgatttgtcttctttgccttttctcctacctttttccatgagtagtcataaccatccacattaaccacyggcataacatagaaatccacaagcctcaggagattggtatattgccctattatcccatagaattgagttatctgcaaattaaaccaagtatatttaatta

SEQ ID NO: 3312 - DNA, 201 bp, Homo sapiens
agcacacaaaatcagtagcatttatatacaacaatagcagacaacctaaaagaaaaatcaagaaagaaataccatttacaatgaccaaaaaaaaaaacctrtaataaatctaaccaaagaagtgaaagacctacaattaagaccatagaacactgatgaaagaaactgaagagaacacacaaaaaaatgaaaagatacctc

SEQ ID NO: 3313 - DNA, 201 bp, Homo sapiens
gagccctgaagaggcaggaaacttgaggtcgagactctgctttaccattaagcagtcatgttaatttgggcaactacttcatcgtctcagcctcaggggcmtcatctgtaccaggaaggaacttgggccactggatccctccaagctcaagcattctttgatctatagacatggaaccaagcacactgtgagatatctata

SEQ ID NO: 3314 - DNA, 201 bp, Homo sapiens
gtagcttttcctaggaactggctatgaattcctaacggacatcatctcaaacttgttcctctctactttagagtcatccagcttagtggcacatattgcartgtgatccaatggcatccaaatttggtgactgagaagtttaccccaaaatgacaaaatgtacaggcaggagaactataaagacaaattttagctggtcaa

SEQ ID NO: 3315 - DNA, 201 bp, Homo sapiens
tttcatataaatggaataatatatgtggcattttgtatctggtttcttttacttagcatagtattttcaagattcatctatgttgtagcatgaatcagtayttcattccttttgattgctgattgatgtttcattgcatgaatatgctgcattttgtttttctgctcataagttgatggaaatttgagttgtttccacttt

SEQ ID NO: 3316 - DNA, 201 bp, Homo sapiens
ggcttacttcatttagtgagtgatactgttcatagtacgatgcggaggctcgggggctgactgtgtcgttggaaatctgctgttgaataagatcttccacrtctgccagcaagacactaggtgatgaaacagagagtgagctagtttccaagcagagggtggatcttcccacatggcccattgcaggcacagcaggtgagc

SEQ ID NO: 3317 - DNA, 201 bp, Homo sapiens
caatttttccatggatggggcagagttggggtggaatcagtggtggggatggtttggggataaaactgttccacctcagatcatcaggcattagattctcmtaaggagcatgcaacctaaatcctttgcatgcgcggttcacagtggggtttgtgctcctatgagaatctaacgctgccactgatctgacaggaagcattg

SEQ ID NO: 3318 - DNA, 201 bp, Homo sapiens
ttcacttgtcttgggtatacacctaggagtagaactgctgggtcatatggtaactctatacttaatcttttgaggaacttccacattgtttttcaaagtgrctgaagaaattttgcctgacgacaaataaatatttgttgaaggtacgatttaccaacatggcaagtaacataactgaaatcctgtcctactagagatggt

SEQ ID NO: 3319 - DNA, 201 bp, Homo sapiens
tccatagcataaagtgttattcccagcagttagagatattcttagctgtagacaaacatcctgcagtttaccaaatatgatgcagtcttctcagggaagakatctaccaaaaaatgaatgaccaccatttaattaacctaagtgtgtttgtgttttattttttaccatcttccaccaattatgattcttgaatattcccct

SEQ ID NO: 3320 - DNA, 201 bp, Homo sapiens
tcaagaacacctccaaaattaatcataatgtatttgcctttaaaagtcagctacaacacagtttagggtatagagcagtggtccccaacctttttggcacyagggaccagtttcatggaagacaatttttccatggatggggcagagttggggtggaatcagtggtggggatggtttggggataaaactgttccacctcag

SEQ ID NO: 3321 - DNA, 201 bp, Homo sapiens
gaggtgtggagacacacccggagcaaaaactccctcaagattttcctgagtgcatatttttttatgtggattatttctttatttcacacaaaaagaagcayacatctaacctctcacgaacttaccagcaaatccagggacagaggcttttttcccagtatggtgggctaacacaagctgctaactctggaataagaatca

SEQ ID NO: 3322 - DNA, 201 bp, Homo sapiens
acacctcggcctctcaaagtgctgggattacaggtgtgagccaccgtgcctggccaggactcttggttggttttgccaaaactttcttagaactgcactaygacctgaaatgttccctacctgcttccttcctttcctctctcctccacaggggttaagcttgcattgcagtctcatggctctcccagcctcctccagccc

SEQ ID NO: 3323 - DNA, 201 bp, Homo sapiens
cagagaactaatgatttgggctgtatcttcatgcttcatttagaggtaaatgggtgtgagttggatggcaatcttccccgggaggtgtggagacacacccrgagcaaaaactccctcaagattttcctgagtgcatatttttttatgtggattatttctttatttcacacaaaaagaagcatacatctaacctctcacgaa

SEQ ID NO: 3324 - DNA, 201 bp, Homo sapiens
tgagcaaggtgaagaggagctttactgagtaatagaacagctcagaggagactcgcggtgggtagctcctctctgcagccagggtgtcctgatgagtgttmgttctcagcagagaggagaccctggagtgggtggctcctctctacagctggtcctccccatgtctctccagaagagtctggctgaatccgggggatttct

SEQ ID NO: 3325 - DNA, 201 bp, Homo sapiens
ataaaggggattacatcaaactgaaaatttgcttctgcacagcaaaggaaataacagcgtgaaaagaaaaaaatgggagaaaatatgtgcaagctatccakccaacagggacttaataaccagaatatataaggaacgcaaacaattcaaaaggaaaaaaacaaataatccaattttaaaaatgagaaaggaatctgaaca

SEQ ID NO: 3326 - DNA, 201 bp, Homo sapiens
atgtgaatacttacatggcctatgaaccacaagcagaaagcaggagagatccattctctggcatggattccacagtcaatccatatggcatttttggctgyttgttcttttccagaaacctgctcaaagaaaccccaaaagtagcaaaaacagtaacaataagcttcaggataataactttcatttatatagtgcttatat

SEQ ID NO: 3327 - DNA, 201 bp, Homo sapiens
cctgcctcggggagttcttaggtctgagctccccaaaaggctgcagctcttctctccttcttgtcacccacaacgtggcaagcaaggggcgtgtttcagcyctgtttgtgttagagctctttcacctccaccatttggcaggttcagcgcccgggaacaatgacgtacgtggacaagcggagggtgagcaaggtgaagagg

SEQ ID NO: 3328 - DNA, 201 bp, Homo sapiens
gaccctggagtgggtggctcctctctacagctggtcctccccatgtctctccagaagagtctggctgaatccgggggatttctatgggcttcagatgggargaagtgagtgctgattggttcatgggtggccataggcgggtgcggaaaaatcaccgtcagttcccactgcggtccacgggactggcagccttcctgggct

SEQ ID NO: 3329 - DNA, 201 bp, Homo sapiens
gatttttgaaatccttattgagttgtagaaaagagtgagagacttaaaagctaagattttaatttgcctttgggtggtttagtttttgaatataaaacctrccttcacaattgttgaaaggtaaatattttattttactttccctcctccagtgctttgaagtactaagagagtcagatgatctgaattagttttaggcag

SEQ ID NO: 3330 - DNA, 201 bp, Homo sapiens
gagctatgacatggtctgatgatgctctctgccttctccagctcccgcctctatcctccaacagcattcccctcatcgcttgctcctccagtctagtcttracctctgcttcttggaaaacactaacaaacaaggagccatcaattttgtaccatgatattgttacaggatccctggggtcgcttcaccagcagaaacctc

SEQ ID NO: 3331 - DNA, 201 bp, Homo sapiens
gagggtccttctcagaacactgagagtgcagaaatgcctgggtctgcaaccccagctgggcagctgcagctgcgcccaggagggcagggctcctgcctgcycctggcccccaagagcacagggatgtccaggtctgtagctgcagcgggcagctgcagctgcgcctggggagcatgaggctgccgccctgccatcacagaa

SEQ ID NO: 3332 - DNA, 201 bp, Homo sapiens
gtcagtgcacgatagcaataaaataagagtgcaaccagtttgtgtaagtttctgagaagagaaggatcattggtagtatcaggagaagagaatgctgatcyactccaccaggcctctcagcacatggtgatgtgaaaaaaagagcagcccctctacttgaaggagccaccagggagcagtgtccttaggtcatgtgtcagc

SEQ ID NO: 3333 - DNA, 201 bp, Homo sapiens
atgtgtgaattctgaaacaatacccttagatttgcctgattcaactttataaaaatggtatactatatgtattcttctgaatcttgtttttcttttgttcrgtattgtattctcaagattatcatctgtgttgaagtagctagccacagttcacacatgaaagcattttcttacaagtggaattgccatttcatgggatat

SEQ ID NO: 3334 - DNA, 201 bp, Homo sapiens
gaactgtgaagatacattgttaggtgactctcacacatggactttgaattcactcagaatgatggcaagagttggaggggaataaagaatcatgaaccggrtaccaggaaattatctgaaggtcagtgcacgatagcaataaaataagagtgcaaccagtttgtgtaagtttctgagaagagaaggatcattggtagtatc

SEQ ID NO: 3335 - DNA, 201 bp, Homo sapiens
gaccatagaacactgatgaaagaaactgaagagaacacacaaaaaaatgaaaagatacctcatgctcacgggcttaagaattaatattgttaaaatgtccrtactaccgaatggaatctacagattcaatgcaatccctgtcaatatcaatatactcttcatagaaagagaaaaaaaattctaaaattcatatggagccat

SEQ ID NO: 3336 - DNA, 201 bp, Homo sapiens
gcacagcaaaggaaataacagcgtgaaaagaaaaaaatgggagaaaatatgtgcaagctatccagccaacagggacttaataaccagaatatataaggaaygcaaacaattcaaaaggaaaaaaacaaataatccaattttaaaaatgagaaaggaatctgaacagacatttctcaaaagaagacacacaaatgggcaaca

SEQ ID NO: 3337 - DNA, 201 bp, Homo sapiens
tagttcgattctggacctctctcttgggtggaagtccagttgtatttgaggttctgtcaagataataggggaaggaaaaagcaaaaaaaaaaaaaaaaaagaaaagaaaagaaaagaaaagaaaaaaattctgactttaggctagcacccacttcaaagcaaacattgaattattgtctggtttgggattgctgggattga

SEQ ID NO: 3338 - DNA, 201 bp, Homo sapiens
taaagatattctcatatacttcttctgtccttcttatttaaattttaaattcaattgaaaattatttggttgggtgcagtgtaaagaagaaatagacttctttttttttcttcttagcatcgtttattattatgattttttacatcatctatatttttcccagggatccactatgtcaattttgtcatatatcaagtttcc

SEQ ID NO: 3339 - DNA, 201 bp, Homo sapiens
cacctgtctcccttgcaaccttgagaaagtggctaagagatcctcagagatgccagccctgtctccagacttatggttatgggagaaaaaataaaccccaytttccttaatccactgtaaatttagtttttctgatatttgtagttttaaagctaccatcaatatagcccataaaagaaaagcctcacttcagagctcaga

SEQ ID NO: 3340 - DNA, 201 bp, Homo sapiens
tcaaaattaaaaaaaaaaaattcatccttgaggggaaatgacaaatatcagtaccacccttaaagacctaaaagatgcagggatgatagatcccatcaaawccacatttaatttgccatctggatcccacaaaaaccagatggatcctggaaaacgacagcaaacaatcaaactcaaccaagcaacaatctcaattgcagc

SEQ ID NO: 3341 - DNA, 201 bp, Homo sapiens
catttcccactggcttcttgcagctaataactgagtatggtggggatactaagggaggctctttctacaaaactggaaactcttctgatgtgtgactctgsctataggactttttttttttttttttttttttgagacagagttttgctcttgtcacccaggctggagtgcaatggagcaatcttggctcactacaattct

SEQ ID NO: 3342 - DNA, 201 bp, Homo sapiens
tggcttcttgcagctaataactgagtatggtggggatactaagggaggctctttctacaaaactggaaactcttctgatgtgtgactctgcctataggactttttttttttttttttttttttgagacagagttttgctcttgtcacccaggctggagtgcaatggagcaatcttggctcactacaattctgcctcgtggg

SEQ ID NO: 3343 - DNA, 201 bp, Homo sapiens
ggcttcttgcagctaataactgagtatggtggggatactaagggaggctctttctacaaaactggaaactcttctgatgtgtgactctgcctataggactttttttttttttttttttttttgagacagagttttgctcttgtcacccaggctggagtgcaatggagcaatcttggctcactacaattctgcctcgtgggt

SEQ ID NO: 3344 - DNA, 201 bp, Homo sapiens
cattaatttaaatttcaaattccacaaggggatattgagcaccaattatgttgaccaaacaatataccaggttatggggaacaaaaaaattactttagacytggtctctgccttcagaaagctaatagaagtgataagttggaaagggaaaagcagcagttcaatgctattaatataagtatgataataaacaatggcaag

SEQ ID NO: 3345 - DNA, 201 bp, Homo sapiens
gaacttccacattgtttttcaaagtggctgaagaaattttgcctgacgacaaataaatatttgttgaaggtacgatttaccaacatggcaagtaacataaytgaaatcctgtcctactagagatggtctgcaatatacaatgatttcacttatgattttttgactttacaatagcgcaaaagcaatgcatattcagtagaa

SEQ ID NO: 3346 - DNA, 201 bp, Homo sapiens
gttaatggggttgctaaaaaaaaatataagacacatgaagggaaaattttaaaacaaaatgtcattttcattaccattacaaatatatcagagagctatcygtctcagtttttactccaatctctatatatgtatgtatagtttgaactgtagccaatgacaataaagtatttatcccaacagtaggtactgtttagatac

SEQ ID NO: 3347 - DNA, 201 bp, Homo sapiens
atcaggttcacattgttggagcaaaatactcagctataagatccttgggctatattttgttcatccttgtatttccaggatctgaaacatcataggcaatytataaatatttgtggattaaataatttaatcttacaaagattcagcaagcagtttgggtagagggtaggatgtctaataggagggcagaggtgtcagggt

SEQ ID NO: 3348 - DNA, 201 bp, Homo sapiens; identical to SEQ ID NO: 699

SEQ ID NO: 3349 - DNA, 201 bp, Homo sapiens
tgatattcagtattcggtagattaggtatattaaatgcattttttacttagaatattttcagttgtgattgtttattgggtatattgagacataaccccaycataaattgagaagcctctgtataaaagaaaaagaagatgagaatagaggagaatggagaagagtgtaagactgagtgatgagagggtgggattgattcc

SEQ ID NO: 3350 - DNA, 201 bp, Homo sapiens
aagcagaaatttattgaaaatttggagcagaaatctttaatgtacttctgaccacccttccttttgttgagtaggatccaatgatcagcgtgagatgatcwttgattaaacttgcttgagatggctagtcaaacgtcgaaagttgcttgagatggctagtcaaacgtcgaaaatcaaagaaaaagtaggtaactagacttt

SEQ ID NO: 3351 - DNA, 201 bp, Homo sapiens
ttcagtgctacttttaacttgctaaagtggtttagtaagtttagtaaataaaatgggatggtgatatttgttgccagaccaacgttcattcattcctttgrtagattataatttgcatcacttgagatggtaggctgccttccaacacttctccccctgtccctaattcacaaggtgaagccccagcaagctgcatgtgac

SEQ ID NO: 3352 - DNA, 201 bp, Homo sapiens
ctttgaatttcctgtattgtctgttatgttccaaaaaacagactctctcctcaatgctaaaattggaggtactttaataggaccaaaaccctgagggttarggaagtcagggcaggaacaattcctgctgctaataccaaaacaatgagtgctgtgttgagacttaatctgtggtgtgctgttgtaggaagctagtgacca

SEQ ID NO: 3353 - DNA, 201 bp, Homo sapiens
tgctggacagtgagcctcagattctcattctatgattgtcattctagagatttcaagcattttagtggaaagagccctgaagaggcaggaaacttgaggtsgagactctgctttaccattaagcagtcatgttaatttgggcaactacttcatcgtctcagcctcaggggcctcatctgtaccaggaaggaacttgggcca

SEQ ID NO: 3354 - DNA, 201 bp, Homo sapiens
tgatattaaataaagagtaaagatggaatatattatactgtgaggagcttttaggtaattgcaaaagggaaacaaaatttaaaatgttattaggacagagratcttactacagattcagtgtaataagagaacatatactctcagtctttatgctcctaagcaattgcaaaatcaacagctctcttgactgggggtcagtt

SEQ ID NO: 3355 - DNA, 201 bp, Homo sapiens
agccaggttgtgacaacacctaggctcagcctcaattttgctccaagattggagtgagcaccaggaactcggagagaccagacagtgggagcaggcacttscgagcctgtaggggaatgagggtccttctcagaacactgagagtgcagaaatgcctgggtctgcaaccccagctgggcagctgcagctgcgcccaggagg

SEQ ID NO: 3356 - DNA, 201 bp, Homo sapiens
agtggctgaagaaattttgcctgacgacaaataaatatttgttgaaggtacgatttaccaacatggcaagtaacataactgaaatcctgtcctactagagwtggtctgcaatatacaatgatttcacttatgattttttgactttacaatagcgcaaaagcaatgcatattcagtagaaaccatacccatgccaccattcc

SEQ ID NO: 3357 - DNA, 201 bp, Homo sapiens
tgcctagaggttctaggaagagcagctagaacttggccactggggaaaaaaataaaagaggattttgatattaaataaagagtaaagatggaatatattayactgtgaggagcttttaggtaattgcaaaagggaaacaaaatttaaaatgttattaggacagaggatcttactacagattcagtgtaataagagaacata

SEQ ID NO: 3358 - DNA, 201 bp, Homo sapiens
tattataaattaggctctgtgttagaagattttgccctactgtaggctaacgtaagtgttctgagcacatttaaggaaggttaggctatgatattcagtaytcggtagattaggtatattaaatgcattttttacttagaatattttcagttgtgattgtttattgggtatattgagacataaccccaccataaattgaga

SEQ ID NO: 3359 - DNA, 201 bp, Homo sapiens
gttgtagtaagattctgtagaacttgaacttgcctagaggttctaggaagagcagctagaacttggccactggggaaaaaaataaaagaggattttgataytaaataaagagtaaagatggaatatattatactgtgaggagcttttaggtaattgcaaaagggaaacaaaatttaaaatgttattaggacagaggatctt

SEQ ID NO: 3360 - DNA, 201 bp, Homo sapiens
gcgacagagggagactccatctcaaaaaagaaaaaaaaaagtgaagtggtgctgcattatggactcactcgggtgaccgaaagagagcagagagggaaatsgtcccaaataggcagagcttcagtgttgcatctcatcatacaccttgggtggaaaaggtgtttccagtgttagaatatgcaggaattcatggagagtggc

SEQ ID NO: 3361 - DNA, 201 bp, Homo sapiens
aaatagttatattaggcaatatagctgcatactcataaaaaggcatcaaggtatttttactacttggagaatatcatataaaaaagaaagtcctcctgcgmatttattctttcaactaacaaatacagggaatggcttttagtggattatgtgaaagcttgctgaggtctcacctgcacatcaacatcttactcaagttct

SEQ ID NO: 3362 - DNA, 201 bp, Homo sapiens
gtacaagtaaaaaatgaagtgggctgggcacggtggctcacgcttgtaatcccagcactttgggaggccgaggtgggtggatcacctgaggtcaggagttygagacgagcctggccaatatggtgaaatcccatctctactaaaaatacaaaaaattagctgggcatggtggcgggcacctgtaatgccagctacttggga

SEQ ID NO: 3363 - DNA, 201 bp, Homo sapiens
gactccctcctgttcttaagtgaagtcagtggaagcagaatttctggtttcatttcaggtccacatcacgctgagcacccatgagtgtgccggcctttcakaacgggacataaacctggccagcttcatcgaacaagtagcagtgtccatgacatagaccctgcccttcctctttgaattcttccgggggaaggggtgact

SEQ ID NO: 3364 - DNA, 201 bp, Homo sapiens
cagggctgagcccagcagctagtgactccctcctgttcttaagtgaagtcagtggaagcagaatttctggtttcatttcaggtccacatcacgctgagcayccatgagtgtgccggcctttcagaacgggacataaacctggccagcttcatcgaacaagtagcagtgtccatgacatagaccctgcccttcctctttgaa

SEQ ID NO: 3365 - DNA, 201 bp, Homo sapiens
tttctgattttcagattagagatgctcaacttgtcagtataatgcaaatattccaaaatccaaaatctgaaacacttctggtctcacacctttcagataasggatactcaacctatattttcttcctggctgtgatggctaatgttaggtgtcaacttgattgggccatggggtgcccaggcatttggtcaaacattccgg

SEQ ID NO: 3366 - DNA, 201 bp, Homo sapiens
tattaaaagtgacatagcagtatattcacatgactacttaagtctaatgcagaaacaagacagtacagtttttgcagaggccgatgtgacatctgcatgcracatgatactattaagtgtctctacccacctctgctacagagtagctgctatatgcacacatacacaaaaatacacaatgaaaagcctacaaaagtgtta

SEQ ID NO: 3367 - DNA, 201 bp, Homo sapiens
ctggggccatattacaggttgaacatccctaatttgaaaattggaaatccaaaatctgaaactttttgaatgccaacatgatgcccaaaggaaatactcaytggatcattttagatttctgattttcagattagagatgctcaacttgtcagtataatgcaaatattccaaaatccaaaatctgaaacacttctggtctca

SEQ ID NO: 3368 - DNA, 201 bp, Homo sapiens
ccctcctgttcttaagtgaagtcagtggaagcagaatttctggtttcatttcaggtccacatcacgctgagcacccatgagtgtgccggcctttcagaacrggacataaacctggccagcttcatcgaacaagtagcagtgtccatgacatagaccctgcccttcctctttgaattcttccgggggaaggggtgactgaac

SEQ ID NO: 3369 - DNA, 201 bp, Homo sapiens
aactattaccaattaccaattaactagtactaattaactattactagagtgaattaatgctaggtggcaggataagaaatgagctaaagggaacgcaagtgattaatggtgaaaagggcaaatctggaggctttgagttatgccttgaagacctgggtaggattcttgggaggcagagatggctgagagaacaccatgaac

SEQ ID NO: 3370 - DNA, 201 bp, Homo sapiens
aaaaacacaaaaaaattaggcgggcgcggtggtggacgcctgtagtcccagctactggggaggctgaggcaggagaatggtgggaacccgggaggcggagsttgcagtgagcagagattgagccactgcactccagcctgggagacagagcaagactccgtctcaaaaaaaaaaaaaaaaaaaaatacagacacatagcca

SEQ ID NO: 3371 - DNA, 201 bp, Homo sapiens
ttcatattttccatactcttgcccttctcccggtggtgactaccaggctggctgcccactaccaggtttgtggtgaggaggtaagtgtaggctctctgctkcccggggctgtggagctttctcagccttcccacccatccgcttcagtgcagtggaccctgccttatatccggggcaggtccttcatgggagagcttccca

SEQ ID NO: 3372 - DNA, 201 bp, Homo sapiens
taaaaacacaaaaaaattaggcgggcgcggtggtggacgcctgtagtcccagctactggggaggctgaggcaggagaatggtgggaacccgggaggcggascttgcagtgagcagagattgagccactgcactccagcctgggagacagagcaagactccgtctcaaaaaaaaaaaaaaaaaaaaatacagacacatagcc

SEQ ID NO: 3373 - DNA, 201 bp, Homo sapiens
gacattggtcttttcctgctttcggacttaaactgaaacatccactctccttaggtctcaaggctacaagcctccggtgtgcaacaataccatctgctttsctggttctccagcttgccaactacagatcttgggacttgtcagcctccataatcacatgagccaattccttataagaaatctctttgtgtgtattggttc

SEQ ID NO: 3374 - DNA, 201 bp, Homo sapiens
gcctctgtttttttccctcttctaggctggcaaagcacacaggctgagcgctgaggagagggaccagctgctgccaaacctgagggctgtggggtggaatkagctggaaggccgtgatgccatcttcaagcagtttcatttcaaagacttcaacagggtatggcaccagggtgggacagagttttctgagacgggctgatg

SEQ ID NO: 3375 - DNA, 201 bp, Homo sapiens
gggcgaggtgggagcgggaaggggcgggggaaagtcttttcgagtcccctgcggagccgccggggtccgaaagtggggtctctgcccggctctctgtcgcyggcggcggggaggggaagctgaagccctgagaggggcggtggcgggtccgaatcccacccagttgggaggccaggcctgccctgaccccggccagtgctt

SEQ ID NO: 3376 - DNA, 201 bp, Homo sapiens
ctgcggagccgccggggtccgaaagtggggtctctgcccggctctctgtcgccggcggcggggaggggaagctgaagccctgagaggggcggtggcgggtycgaatcccacccagttgggaggccaggcctgccctgaccccggccagtgcttgttccgggacccttccgggggcggggcctacgaccttcctgggccggg

SEQ ID NO: 3377 - DNA, 201 bp, Homo sapiens
ccaaattttgttcctgccatttgttcctattgctgcagaacaaatcatcacgctgagtggcttaaaacaaaaattatgatttctcatgcttccacgggttractggtctcacttggggcctcacgtgggattgaagtcagatgtctcctggggctgaagtcatctgaaggtttggcaggtctgagcatccaagagtctcac

SEQ ID NO: 3378 - DNA, 201 bp, Homo sapiens
ctcgtgtgcgtgcctgtccgctgccccttcccgctggcactctgggtacggggtctgcctgggactcacgctctgcgccggtatgctggccccagagccastccccgcgccggcttgaggcccgtgccaggccacgggggcttggtggcgctggagcagccctcctcccgtgagcttcccccacccacccccggggcgggg

SEQ ID NO: 3379 - DNA, 201 bp, Homo sapiens
gggggcttggtggcgctggagcagccctcctcccgtgagcttcccccacccacccccggggcgggggcgggggcggggcccttgctctgctgtaagctcgsgagcttcatcagaccatttctggtccacaggccttcggagcaggcaagactgggagggccttttgataggagagggacttgggggagggaggatgagtgg

SEQ ID NO: 3380 - DNA, 201 bp, Homo sapiens
ctctctgtctccagagccggcacctggaaggtttgtcagttcagccgcaggctgtgcgacctggggggttccagaaggctctaccgagaaagggaagcctyctaagagctcacctggactcacccacccctttaagagccaaggaagtaaacagtgggctctgatgctttggctgacttctggttgtctagatacacggac

SEQ ID NO: 3381 - DNA, 201 bp, Homo sapiens
ggagatagttcaagtggaaaccatgcacatctgaagacatttgaacagacggccaagactggccaggccaaaagcctgttgtggtgtttccaccttgttgrcatcctaaatagcaagactttcttcctactgcaaggacaatctctaactcaagcctgagaaccagtgacaggatgtcaagggggaaatgattatagagga

SEQ ID NO: 3382 - DNA, 201 bp, Homo sapiens; identical to SEQ ID NO: 706

SEQ ID NO: 3383 - DNA, 201 bp, Homo sapiens
ggaagcaagcaggccgagcgcgtccctggctggggacgttaatcattaccggagggcggcccgagcgcggccccgccccgggacggcagcctgcgcgcccrgccgccgcctgccctctccgctggccacctgctgccgcccgcgccatggtgagtccaggggtgcgcggccgcgatcggggcagcggggccggggcagccg

SEQ ID NO: 3384 - DNA, 201 bp, Homo sapiens
ccaagagaggtacagccacctggctggtaaatggtgaaagcgggtctcaaaactcctgccaatcaacacatggtgtccagtctgcaggctgcctcataaawgctaaatcaacctccctcacattccctccccacccctaagggtatcttttcaattcagcactctatttctgccctggggtggtgctactctagaagccta

SEQ ID NO: 3385 - DNA, 201 bp, Homo sapiens
gcggagccgccggggtccgaaagtggggtctctgcccggctctctgtcgccggcggcggggaggggaagctgaagccctgagaggggcggtggcgggtccraatcccacccagttgggaggccaggcctgccctgaccccggccagtgcttgttccgggacccttccgggggcggggcctacgaccttcctgggccgggga

SEQ ID NO: 3386 - DNA, 201 bp, Homo sapiens
ggaagcagaatttctggtttcatttcaggtccacatcacgctgagcacccatgagtgtgccggcctttcagaacgggacataaacctggccagcttcatcraacaagtagcagtgtccatgacatagaccctgcccttcctctttgaattcttccgggggaaggggtgactgaactgggagtccagggagggagctgagga

SEQ ID NO: 3387 - DNA, 201 bp, Homo sapiens
cggagccgccggggtccgaaagtggggtctctgcccggctctctgtcgccggcggcggggaggggaagctgaagccctgagaggggcggtggcgggtccgmatcccacccagttgggaggccaggcctgccctgaccccggccagtgcttgttccgggacccttccgggggcggggcctacgaccttcctgggccggggaa

SEQ ID NO: 3388 - DNA, 201 bp, Homo sapiens
agcagaatttctggtttcatttcaggtccacatcacgctgagcacccatgagtgtgccggcctttcagaacgggacataaacctggccagcttcatcgaayaagtagcagtgtccatgacatagaccctgcccttcctctttgaattcttccgggggaaggggtgactgaactgggagtccagggagggagctgaggagcc

SEQ ID NO: 3389 - DNA, 201 bp, Homo sapiens
tgaggtcccagagatgcaggcttgggaaatcggtaaccactccccacacctcgccagaggaggcaaacggggcagcgtccccctctctgtctccagagccrgcacctggaaggtttgtcagttcagccgcaggctgtgcgacctggggggttccagaaggctctaccgagaaagggaagcctcctaagagctcacctggac

SEQ ID NO: 3390 - DNA, 201 bp, Homo sapiens; identical to SEQ ID NO: 709

SEQ ID NO: 3391 - DNA, 201 bp, Homo sapiens
aaaagcagacggaaaaccagagaaacctagccctggcggctcaggaccagaggctgcctgggagcatgactgaggacctactagaggtagtgccaacggcrgtcagctgcagtgtggctaagaatgggatggacacttattttaaatgtagctccttcgtccagccccagcaatgctgacacacagacaacactgcgccat

SEQ ID NO: 3392 - DNA, 201 bp, Homo sapiens
cctaggttctgggatctgttaagctcctagacctggatcctcctaggatgaaactgacccttgcttccttgctttctctgaggttccactcatggcctgarttgtgccaatttgggctgccttgagggcacttcgcacattaggtaaataggatggggcactaggtttgccagctgcctttggccaagttccttccacttt

SEQ ID NO: 3393 - DNA, 201 bp, Homo sapiens
cccacctggcttcaaccccaggaatgcgtccagcgtgatccagggcctgcagaacaggtgctggttctccctccccgtctacagctctggggatcggaggsgggggggcaattgtccagcccccaggcaacaggggaagggccttggccaacatctgggtgccagcagggcaggggtggggctctgaggggataagggctt

SEQ ID NO: 3394 - DNA, 201 bp, Homo sapiens
caattgtccagcccccaggcaacaggggaagggccttggccaacatctgggtgccagcagggcaggggtggggctctgaggggataagggcttttaaaagsctccccagggaggttccccagttcctccacctgctggcccctggacacctctgtcaccatgtggttcctggttctgtgcctcgccctgtccctggggggg

SEQ ID NO: 3395 - DNA, 201 bp, Homo sapiens
ccaactcacataaccctggatgagggattctcctggcatatgctggcctctgggccacagaggtaatcatgtgattctggctgagccaatcacagtacccyagctgcagaccctgcaattggcccaaagatggacacatgaccaaagcccaaccaatcaagctctgccccaagactttttattaggaagctgtcaaggaaa

SEQ ID NO: 3396 - DNA, 201 bp, Homo sapiens
gtatttttagtagagacatggtttcaccatgttggccaggctggtctcaaactcctgacctcaggtgatcggcttcccaaagtgctgggattacaagcgtsagccactgagcccagcctcgatcatttctagaaccacccccacagacacccctggtcaccctacttgaactcctaaaaggtgtctcataacaactcatgt

SEQ ID NO: 3397 - DNA, 201 bp, Homo sapiens
gggcgggaggaggactcagcacagggccacggccagtaacatgaagcccttgctcatatggatgagaactggggagagggggacaggggccccagagtcamccccagatacccctcttggtcaccctccaaagtcatctctgctgatacccacaagcagcccaacagacaaccccaaagtctggcacatcctcaaaatcac

SEQ ID NO: 3398 - DNA, 201 bp, Homo sapiens
aggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttg

SEQ ID NO: 3399 - DNA, 201 bp, Homo sapiens
tgtcctccagaccctgacatctggtctccccagtccttccagggtcccccaaatttcaccagaaaaccctgcttcccaaactggcatgtgggatcccccayctggtatgggggggggtctgcaaatgtcccttcccacccagcacccccagctctcccaggaaaaacaccacaccctcccaccacatgctcctttccttgg

SEQ ID NO: 3400 - DNA, 201 bp, Homo sapiens
cttcccaaactggcatgtgggatcccccatctggtatgggggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctg

SEQ ID NO: 3401 - DNA, 201 bp, Homo sapiens
ccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacatcaagtgggtcctgcattgc

SEQ ID NO: 3402 - DNA, 201 bp, Homo sapiens
gtgcaccccactcccagccatggcaagtggctctctacgagcgtggacgctttaactgtggcgcttccctcatctccccacactgggtgctgtctgcggcmcactgccaaagccggtatgaaggcaggggctcagggtcctgagggagcctggttcggggggaagagctcctagatttgggggaagacggaggcagacgcc

SEQ ID NO: 3403 - DNA, 201 bp, Homo sapiens
agtagtcctggagaggtggcctctgcgatgtgcccgcaggggcagcgtcctgcagatggtcctgcccctcctccccctaacctgtctgcaggcactgtccwcctggaccctgccccatgtgcaggagctggaccctgaggtcccttcccccttggccaggactggagaccctgtcccctctgtgggaatccctgcccacct

SEQ ID NO: 3404 - DNA, 201 bp, Homo sapiens
atctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctaacctgtctgcaggcactgtccacctggaccctgccccatgtgcaggagctggaccct

SEQ ID NO: 3405 - DNA, 201 bp, Homo sapiens
tgttgttaccgtcgagtcagagagtagtcctggagaggtggcctctgcgatgtgcccgcaggggcagcgtcctgcagatggtcctgcccctcctccccctracctgtctgcaggcactgtccacctggaccctgccccatgtgcaggagctggaccctgaggtcccttcccccttggccaggactggagaccctgtcccct

SEQ ID NO: 3406 - DNA, 201 bp, Homo sapiens
ctgcgatgtgcccgcaggggcagcgtcctgcagatggtcctgcccctcctccccctaacctgtctgcaggcactgtccacctggaccctgccccatgtgcyggagctggaccctgaggtcccttcccccttggccaggactggagaccctgtcccctctgtgggaatccctgcccaccttcctctgggagtgggcactgga

SEQ ID NO: 3407 - DNA, 201 bp, Homo sapiens
ctggttttctggaaccccacgccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatc

SEQ ID NO: 3408 - DNA, 201 bp, Homo sapiens
gcgatgtgcccgcaggggcagcgtcctgcagatggtcctgcccctcctccccctaacctgtctgcaggcactgtccacctggaccctgccccatgtgcagmagctggaccctgaggtcccttcccccttggccaggactggagaccctgtcccctctgtgggaatccctgcccaccttcctctgggagtgggcactggagg

SEQ ID NO: 3409 - DNA, 201 bp, Homo sapiens
ccccccgataagaccttcccctccaacaccccaccctcatccctctggcccacagtctatcctagtccggggtgccccggctcttatctatcttgcgcggscccaccctaaacttccacccccgctcctccatgttgtcatagtgctcactcccacaccagattcctgctcctcccaggaagcctcagtactttctcctct

SEQ ID NO: 3410 - DNA, 201 bp, Homo sapiens
ttttctcccgggttcgtagtctcatttccagatgatctccagtgtgtggacctcaaaatcctgcctaatgatgagtgcaaaaaagcccacgtccagaaggwgacagacttcatgctgtgtgtcggacacctggaaggtggcaaagacacctgtgtggtgaggcagccctgcccccagggtctggaagggctgagggagggg

SEQ ID NO: 3411 - DNA, 201 bp, Homo sapiens; identical to SEQ ID NO: 728

SEQ ID NO: 3412 - DNA, 201 bp, Homo sapiens
gaccctgacatctggtctccccagtccttccagggtcccccaaatttcaccagaaaaccctgcttcccaaactggcatgtgggatcccccatctggtatgmgggggggtctgcaaatgtcccttcccacccagcacccccagctctcccaggaaaaacaccacaccctcccaccacatgctcctttccttggggaagttcc

SEQ ID NO: 3413 - DNA, 201 bp, Homo sapiens
acacccgcgctacgaagcgcgcagccaccgcaacgacatcatgttgctgcgcctagtccagcccgcacgcctgaacccccaggtgcgccccgcggtgctayccacgcgttgcccccacccgggggaggcctgtgtggtgtctggctggggcctggtgtcccacaacgagcctgggaccgctgggagcccccggtcacaagg

SEQ ID NO: 3414 - DNA, 201 bp, Homo sapiens
tttccctagcctaggagccccttagccctccagattcttcctcagtgagcctctgatcctgtcccacccttggcgccttgatccctggtttccagaatccytttccactcccctaacccaccacctcccatcccccagccccagaccccaaatgacctgacgcccagatgcagtgtctgctccagacactgtctcctgtct

SEQ ID NO: 3415 - DNA, 201 bp, Homo sapiens; identical to SEQ ID NO: 730

SEQ ID NO: 3416 - DNA, 201 bp, Homo sapiens; identical to SEQ ID NO: 723

SEQ ID NO: 3417 - DNA, 201 bp, Homo sapiens; identical to SEQ ID NO: 724

SEQ ID NO: 3418 - DNA, 201 bp, Homo sapiens
acatgagcctcctggagaaccacacccgccaagcagacgaggactacagccacgacctcatgctgctccgcctgacagagcctgctgataccatcacagaygctgtgaaggtcgtggagttgcccaccgaggaacccgaagtggggagcacctgtttggcttccggctggggcagcatcgaaccagagaattgtatgtggg

SEQ ID NO: 3419 - DNA, 201 bp, Homo sapiens
ggtgaggtcgggctgcagccctttttctcccgggttcgtagtctcatttccagatgatctccagtgtgtggacctcaaaatcctgcctaatgatgagtgcraaaaagcccacgtccagaaggtgacagacttcatgctgtgtgtcggacacctggaaggtggcaaagacacctgtgtggtgaggcagccctgcccccaggg

SEQ ID NO: 3420 - DNA, 201 bp, Homo sapiens
tcaccctgtccgagaaggactgccactcacgcctccctcctcctgagccccgtcccagtcctgaccgcaactgtgttctcagggccccaacctcccctcakattgccattcctggttcacaggaaggaccccaaaacctctcggaagcccacctctagccttaaccatagccctttcttttaccctttaaccaggaagccc

SEQ ID NO: 3421 - DNA, 201 bp, Homo sapiens
cagagacatgctaagacagaggccccgaggggagcagcacggaagtctagatacacctccagaaagccagagagcagggctggggttagggagggcccccrccccccaagccaacacctaccaatgccgaggcagaggaaactgaagacaaagtcggccatgttcaggcggaggaccactggccaggaggagagggccatg

SEQ ID NO: 3422 - DNA, 201 bp, Homo sapiens
accctttaaccaggaagccctgaaatctaactgtcccagccaagctggccccttccaaccccaatgtagggaccccaagtcacccccaaactcttcagtcsagatgctcttctttacctctcagacctggttccctaaagctgcatcctttcctgaacctcaaaagcccaacccaggtcctgtttccctagcctaggagcc

SEQ ID NO: 3423 - DNA, 201 bp, Homo sapiens
ccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaattgtatgtgggggcagactgtgtagcccaaggcggggat

SEQ ID NO: 3424 - DNA, 201 bp, Homo sapiens
ggcttcaaccccaggaatgcgtccagcgtgatccagggcctgcagaacaggtgctggttctccctccccgtctacagctctggggatcggaggggggggggcaattgtccagcccccaggcaacaggggaagggccttggccaacatctgggtgccagcagggcaggggtggggctctgaggggataagggcttttaaaag

SEQ ID NO: 3425 - DNA, 201 bp, Homo sapiens
gtggggagcacctgtttggcttccggctggggcagcatcgaaccagagaattgtatgtgggggcagactgtgtagcccaaggcggggatggggactcctgygtccaagggagaaagggccagggaagcaggtgaggtcgggctgcagccctttttctcccgggttcgtagtctcatttccagatgatctccagtgtgtgga

SEQ ID NO: 3426 - DNA, 201 bp, Homo sapiens
cctacccatcctgtctcggccccactcctaagcaccgtccccacctcctccctggctaacaccatgctcaacgctttctctgaccgacattctctctcccygtgcccagggtgactccgggggccctctggtctgtaaccagtctcttcaaggcattatctcctggggccaggatccgtgtgcgatcacccgaaagcctgg

SEQ ID NO: 3427 - DNA, 201 bp, Homo sapiens
caagcactgcattaggggaggtggcagggggctcattcccacagcccctcacgctgtttccacagtacgcctgcctcacaccttgcgatgcgccaacatcrccatcattgagcaccagaagtgtgagaacgcctaccccggcaacatcacagacaccatggtgtgtgccagcgtgcaggaagggggcaaggactcctgcca

SEQ ID NO: 3428 - DNA, 201 bp, Homo sapiens; identical to SEQ ID NO: 740

SEQ ID NO: 3429 - DNA, 201 bp, Homo sapiens
attgccagagatgcagtcagagagactgactgagagacacaaagatagaaggaattagagaaagggccacacagagccagacagagagagaagagtggagrtggagacagggacgaggacagagaaaggcagacagacacatagggacagaaagagaaaaatcacacaaagtcagaattactgaatgacagggaatgacac

SEQ ID NO: 3430 - DNA, 201 bp, Homo sapiens
ttgttcccagaggaacctggggcccgctcctcccccctccaggccatgaggattctgcagttaatcctgcttgctctggcaacaggtacgcaggggatggrggcagggcaggatcctccctcttgaatctctgggatcccctaaccctctgtgtctggacagtgacagggctgattccaaattacagaacaacccataagg

SEQ ID NO: 3431 - DNA, 201 bp, Homo sapiens
tctgcgctcgggttccgcagatgcagaggttgaggtggctgcgggactggaagtcatcgggcagaggtctcacagcagccagtaagtgaacagctggactygggctgcctgggcggcagggagaagcgggcaggggaagggtcagcagaggagcgaggccccagaggagccctggggtggagcacagccaagggctctgtt

SEQ ID NO: 3432 - DNA, 201 bp, Homo sapiens
tcctcttgctcagtggcctctcatcctgccacccctagccttgctggggacgtgaaccctctccccgcgcctgggaagccttcttggcaccgggacccggrgaatccccacggaagccagttccaaaagggatgaaaagggggcgtttcgggcactgggagaagcctgtattccagggcccctcccagagcaggaatctgg

SEQ ID NO: 3433 - DNA, 201 bp, Homo sapiens
ttttaagtgtttggagatctgagtgctgtgagaaacaggggatttccccaaccttgtttctcccaagtggggagcgggagcaggtgagggagagaggagarggcatgagccagcccccccctcccgatttccccgtaaagtgatgcggccccatgtccctccttgttcccagaggaacctggggcccgctcctcccccctc

SEQ ID NO: 3434 - DNA, 201 bp, Homo sapiens
ctttctctcctccccacccccatttctgggagtcctcctggtctaccacctctccttcctgagccccttcttttgctctcaccccctccagggcttgtagrgggagagaccaggatcatcaaggggttcgagtgcaagcctcactcccagccctggcaggcagccctgttcgagaagacgcggctactctgtggggcgacg

SEQ ID NO: 3435 - DNA, 201 bp, Homo sapiens
tgagtgctgtgagaaacaggggatttccccaaccttgtttctcccaagtggggagcgggagcaggtgagggagagaggagagggcatgagccagccccccyctcccgatttccccgtaaagtgatgcggccccatgtccctccttgttcccagaggaacctggggcccgctcctcccccctccaggccatgaggattctgc

SEQ ID NO: 3436 - DNA, 201 bp, Homo sapiens
gctccatccccgtttccacaccatttccagctccaaccatccccaaactcgtttttgagcctaaccccatcctttatcccacccataatcccagctttatygctaaacctatcacctttcccagtgcctacccatcctgtctcggccccactcctaagcaccgtccccacctcctccctggctaacaccatgctcaacgct

SEQ ID NO: 3437 - DNA, 201 bp, Homo sapiens
cacgtccagcccccagtgtaggagcaccagaggggaacctggcagggggtggtgaggagggagtggtcaggattgtggaagggttcagggcatcagagatscggttcacagtgacgatgtgggataagttgagaggatgtgtggaaaacgtcaggataggggggtggggacaaaagttggggccttggagtcagacggacg

SEQ ID NO: 3438 - DNA, 201 bp, Homo sapiens
cagcctccccaacaaagaccaccgcaatgacatcatgctggtgaagatggcatcgccagtctccatcacctgggctgtgcgacccctcaccctctcctcaygctgtgtcactgctggcaccagctgcctcatttccggctggggcagcacgtccagcccccagtgtaggagcaccagaggggaacctggcagggggtggtg

SEQ ID NO: 3439 - DNA, 201 bp, Homo sapiens
agggccgaaccatggcttgacagctcaaagcccctcccaacgacttccacatggttcttggtatctcggaagcttctagctgtgaccaggccctctccaargccaccctagacacctaagatatattttaagtgtttggagatctgagtgctgtgagaaacaggggatttccccaaccttgtttctcccaagtggggagcg

SEQ ID NO: 3440 - DNA, 201 bp, Homo sapiens
cggttgcacagtcattgggcaggggcaggggttgaacgctgctggttacgcggacgggcaggcgcagccgcagcagccggaggtcgtgctcgtggctcgtygaggctcccaggtagccgggatgggtcacagagaagccgctgtgccggatctgctcggtccagtcgagctggctgaggctgtgttcccccaggcgcaccc

SEQ ID NO: 3441 - DNA, 201 bp, Homo sapiens
atgagagttgcgggtgagaggacagacagtgaggggcagaacagtggggagcggcaggagcgcctgagtgtccgtggaggggtgcaaggtgggggactgcrtgcctgccacccgctcagccgtcgccaccggcagcaggtactgggtgcgcctgggggaacacagcctcagccagctcgactggaccgagcagatccggca

SEQ ID NO: 3442 - DNA, 201 bp, Homo sapiens
tccccagcttcaatgacatctttaccgacatccacaatttcatccccaacctcaacccgccgacccctgcaactcccaatccatctcttcccctgttcccrtttctgacctcagcacaaacttcagctccatccccgtttccacaccatttccagctccaaccatccccaaactcgtttttgagcctaaccccatccttta

SEQ ID NO: 3443 - DNA, 201 bp, Homo sapiens
atgagccagcccccccctcccgatttccccgtaaagtgatgcggccccatgtccctccttgttcccagaggaacctggggcccgctcctcccccctccagrccatgaggattctgcagttaatcctgcttgctctggcaacaggtacgcaggggatgggggcagggcaggatcctccctcttgaatctctgggatccccta

SEQ ID NO: 3444 - DNA, 201 bp, Homo sapiens
ctgccctccgtgctttgattccgtcccctttctttctccagccgcagaggcggcgctgctcccccaaaacgacacgcgcttggaccccgaagcctatggckccccgtgcgcgcgcggctcgcagccctggcaggtctcgctcttcaacggcctctcgttccactgcgcgggtgtcctggtggaccagagttgggtgctgac

SEQ ID NO: 3445 - DNA, 201 bp, Homo sapiens
acgcggacgggcaggcgcagccgcagcagccggaggtcgtgctcgtggctcgtcgaggctcccaggtagccgggatgggtcacagagaagccgctgtgccrgatctgctcggtccagtcgagctggctgaggctgtgttcccccaggcgcacccagtacctgctgccggtggcgacggctgagcgggtggcaggcacgcag

SEQ ID NO: 3446 - DNA, 201 bp, Homo sapiens
ggcagggcggggtctctcggaactcccacagctggaggtgcggtccccggtgtccttccagcaggaggagagaccgggcttgcgctgtggccgccaggggrcggtgtggtccttttccgcatttctgggcccgtcactcctctcccgctgattctccttgagctctaggaggaggtggttgcctgcaacggatagaagcca

SEQ ID NO: 3447 - DNA, 201 bp, Homo sapiens
acgtccagcccccagtgtaggagcaccagaggggaacctggcagggggtggtgaggagggagtggtcaggattgtggaagggttcagggcatcagagatgsggttcacagtgacgatgtgggataagttgagaggatgtgtggaaaacgtcaggataggggggtggggacaaaagttggggccttggagtcagacggacgg

SEQ ID NO: 3448 - DNA, 201 bp, Homo sapiens
gtgaggagagaccatctccccaaatgcactgaagggaaactggaggagggagggagtgaggggtgatcataccagcggaggcacatttgctgagccccccygcagtctgctctttccaagtggaccctcctggaagcctgatcccaacctcccctgcaagcaggtctgtcacccccatctctcagatgaagaaactgagcc

SEQ ID NO: 3449 - DNA, 201 bp, Homo sapiens
ttttctctatcaataatgagtgtgggttgtaattgcttagtaagtaattttgtttatgtaaacgtacatttgttaaattttttttcttaggtaatcccgtwtgttggcaccattcctgatcagctggatcctggaactttgattgtgatacgtgggcatgttcctagtgacgcagacaggtaaaatcactgtgctaaagga

SEQ ID NO: 3450 - DNA, 201 bp, Homo sapiens
tgagtgtgggttgtaattgcttagtaagtaattttgtttatgtaaacgtacatttgttaaattttttttcttaggtaatcccgtatgttggcaccattccygatcagctggatcctggaactttgattgtgatacgtgggcatgttcctagtgacgcagacaggtaaaatcactgtgctaaaggaaggagcatgaataggc

SEQ ID NO: 3451 - DNA, 201 bp, Homo sapiens; identical to SEQ ID NO: 756

SEQ ID NO: 3452 - DNA, 201 bp, Homo sapiens
gaactatgtgtcaaaggtttgaagagcaccaaattttcttaactctatataaaaattaagttgtaatgagctgttacgagtaacctgtatccacaatagargcccaaagcagccccctctgcatttgtgtgccgtccctggacggattcgagagtcaaccaggcctgcctctgagccattcctgtgtatttcctcagcacc

SEQ ID NO: 3453 - DNA, 201 bp, Homo sapiens
tgtttatgtaaacgtacatttgttaaattttttttcttaggtaatcccgtatgttggcaccattcctgatcagctggatcctggaactttgattgtgataygtgggcatgttcctagtgacgcagacaggtaaaatcactgtgctaaaggaaggagcatgaataggctgtctttttgtgattgtggaatgataacagagta

SEQ ID NO: 3454 - DNA, 201 bp, Homo sapiens; identical to SEQ ID NO: 760

SEQ ID NO: 3455 - DNA, 201 bp, Homo sapiens; identical to SEQ ID NO: 761

SEQ ID NO: 3456 - DNA, 201 bp, Homo sapiens
acaggtaaaatcactgtgctaaaggaaggagcatgaataggctgtctttttgtgattgtggaatgataacagagtaaggcgggagagaccatttgatactytgaggcccaattagctttcatcagcagccctggccaaggtgctgaggagattggaatgaatgactaaataaaggttattgggatttatttcattgctgta

SEQ ID NO: 3457 - DNA, 201 bp, Homo sapiens
gtcttttgagatcgtgattatggtgctgaaggacaaattccaggtaggttttggagagggacaggttgagtcctcattagtgagcaggagtgcacaggggkgcttttcacatttgtgagcccagccttatatttcctacacctgagatatagtttgtttggctttgtagtttttctccataaaaggaccaggaaggcacct

SEQ ID NO: 3458 - DNA, 201 bp, Homo sapiens
ggaatgaatgactaaataaaggttattgggatttatttcattgctgtaagtctgatttcagtataaaaaattagaactatcagctggatgtggtgacttamacatacttttccagcactttgggaggccaaggcaggaggattgtttgaggccaggagtttgagaccagcctgggcaacatagtgagaccccccatctgta

SEQ ID NO: 3459 - DNA, 201 bp, Homo sapiens
ggttttttggtttttcattgtttgagttttgggcatagatgactgtgaagggcgaacactgccgatggatcaatgaatttgtagtatgtgcaccacttccracttacgggatacccagctttgacggctttggacaaacacactgaggccaagatgtgctgagcttatcaggatcaggatcaccaagcagctgtaaaaacc

SEQ ID NO: 3460 - DNA, 201 bp, Homo sapiens
gtgaatgaatgaggagggattggtcagtcccttgtcactgggcctggagtgtagtgcctgctggtcctttactggtggctttcctttctgagcactcatgrggcccctgtgtcttccctcatatagattccaggtggatctgcagaatggcagcagcatgaaacctcgagccgatgtggcctttcatttcaatcctcgttt

SEQ ID NO: 3461 - DNA, 201 bp, Homo sapiens
agaaaagattagacagtcagctctttaggcctcatagtgaatgaatgaggagggattggtcagtcccttgtcactgggcctggagtgtagtgcctgctggkcctttactggtggctttcctttctgagcactcatggggcccctgtgtcttccctcatatagattccaggtggatctgcagaatggcagcagcatgaaacc

SEQ ID NO: 3462 - DNA, 201 bp, Homo sapiens
tgttttctccccagctttgtcatgtatttagtggccttatgtagacagtttcctttgaaacatctcttggacttctctgctcttccagggccattgccacygacctggaatgtgtccttatcgtttcacgccaggcttatggcagcagtcagtcacccagatgacctcctgacctctggcttatttcacccccactggact

SEQ ID NO: 3463 - DNA, 201 bp, Homo sapiens
cctagtgtggcctcgaaccttctgttgggatcagcagtggaacagtaggaaaaggaatgagtagacatggcattgcaacaagtctttttttttttttctgktagaattatcatattaagcagaagttttgcttcacaaactctcagccaaatacaaaatactatgaatagtatttaccttgtgtctctttccaaagaactc

SEQ ID NO: 3464 - DNA, 201 bp, Homo sapiens
ccccagaaggaaagcaggtgtttagcataaccatattatttgcatgaacagttcaggtacaggaaatccccgttaccagttaggttggtgggtgcccttcycaaatcccaagttcccagacaccagccaggggcctgcctcgtaaggaggcctttccaggacagcagtcaggcctgccaatgttaattcttttctgcatac

SEQ ID NO: 3465 - DNA, 201 bp, Homo sapiens
ggcctagtgtggcctcgaaccttctgttgggatcagcagtggaacagtaggaaaaggaatgagtagacatggcattgcaacaagtctttttttttttttcygttagaattatcatattaagcagaagttttgcttcacaaactctcagccaaatacaaaatactatgaatagtatttaccttgtgtctctttccaaagaac

SEQ ID NO: 3466 - DNA, 201 bp, Homo sapiens
atatgcttgcattgagattatctcaggtctttccattatgccattactttcattttaaatcttcttgctctttcaaatacactttagttgtatctacagtkttttaaaaacaatctcattcagtgttgtaatttcatctgtgggctcttcctctggatgaaatccgtgttccagctgttcggcagcatcagatggttgtga

SEQ ID NO: 3467 - DNA, 201 bp, Homo sapiens; identical to SEQ ID NO: 772

SEQ ID NO: 3468 - DNA, 201 bp, Homo sapiens; identical to SEQ ID NO: 847

SEQ ID NO: 3469 - DNA, 201 bp, Homo sapiens
cgagccagggacagtgctgctgcaggggacccagctgggaccaaggcagactgtctctcccctcctgggatttacagggtcatggctctgaaacattccgkagtgttctttggacacgagttttccctggagatcgctttctgcaggcctcttggtcctgactgtggcttcttttcagaggctgccattcgctgcaaggtt

SEQ ID NO: 3470 - DNA, 201 bp, Homo sapiens
tttgatacaggatacagtgtgtattagcaaggttttctttttaatgtttatatttatttagttgagatcatactatatatggctctatagattactttctcacttatattactaacttgtgttattaaatattctgcataaagataattttaagatgaaatttgatgttataaaaacttctcattttattaagagattaac

SEQ ID NO: 3471 - DNA, 201 bp, Homo sapiens
tttcatcgtctaaaatgtaatcatgtgtgtttgcttcgagccagggacagtgctgctgcaggggacccagctgggaccaaggcagactgtctctcccctcstgggatttacagggtcatggctctgaaacattccgtagtgttctttggacacgagttttccctggagatcgctttctgcaggcctcttggtcctgactgt

SEQ ID NO: 3472 - DNA, 201 bp, Homo sapiens
gaatctcccaaactccattcacctctcccttctctggccttttgagcccgtgtctgtatcattctttttcacagtttttaacagttgtgctttggctttaygtgtttattttgcctccacaatgggattttaagctccctgagtcagagactatattgtatgctgctcgcgttttctgcctataacctaacgtggtacctg

SEQ ID NO: 3473 - DNA, 201 bp, Homo sapiens
tctctggccttttgagcccgtgtctgtatcattctttttcacagtttttaacagttgtgctttggctttacgtgtttattttgcctccacaatgggatttwaagctccctgagtcagagactatattgtatgctgctcgcgttttctgcctataacctaacgtggtacctggcatttgagagggagggaggaggagcctcg

SEQ ID NO: 3474 - DNA, 201 bp, Homo sapiens
cttttgagcccgtgtctgtatcattctttttcacagtttttaacagttgtgctttggctttacgtgtttattttgcctccacaatgggattttaagctccytgagtcagagactatattgtatgctgctcgcgttttctgcctataacctaacgtggtacctggcatttgagagggagggaggaggagcctcgtagcgtgc

SEQ ID NO: 3475 - DNA, 201 bp, Homo sapiens
acctggcatttgagagggagggaggaggagcctcgtagcgtgccgaggacctgcagaagctactttctcgtcatcttactgtagtctgttgaggtagagaytgttcctacttcagaataagaaaaccgaattcaaatatgttgggtaacttgtccatattaatttatttagcaaatacaacagattttgagtgtctgccac

SEQ ID NO: 3476 - DNA, 201 bp, Homo sapiens
ttatccctaagttccagtctaatgcagtgccctggtatgtggagtgtagacagatgtgggctaatcatggaaggttccctgaagttgtggatattggtttsgaattcagaaagctgggaaggatgtggaaggctgaaggttggcttttctagatttagggcatgatttgaacaagtccttagaggtgggaagggcagcaca

SEQ ID NO: 3477 - DNA, 201 bp, Homo sapiens
aatttaacattttgcttgtaagacttaattttgcctgggtatggtggctcatgcctgtaatcctagcacttcaggaggttgaggcaggaggactgcttgarcccaggagttcaagaccagcctgggcaacacagtgggaccccatcactaccaaaaaaaaaaaaaattagtcaggcatggtggtgtgcacttgtagtccca

SEQ ID NO: 3478 - DNA, 201 bp, Homo sapiens
cacacagtcacttagggtcattggtttaggttatcattctacagcattttaaactgacacattgtctggaccatgtgggttcttgaggactcatcaaaacycgttactaaaagcatgaatatcaggcggaatagatagcaatgtgacattcatatttatccctaagttccagtctaatgcagtgccctggtatgtggagtg

SEQ ID NO: 3479 - DNA, 201 bp, Homo sapiens
gcactttgggaggccaaggcaggaggattgtttgaggccaggagtttgagaccagcctgggcaacatagtgagaccccccatctgtaaaaaaaaaaaaaawttaaaaattaactggcttggtggtgtgcgcctgtagttgtagctactcagggggctgaggtaggaggattccttgagcccaggagtttgaggttgcagtg

SEQ ID NO: 3480 - DNA, 201 bp, Homo sapiens
gaatactgtaattctcattttatggaaatgaaaatctaaatgaatacctctggtaattgtacgggactgtttgattagtatttaccattaattaattaaattttttttttttttgagatggagtctcgttctgttgcccaggctggagtgcagtggcacaatctcggctcacttcaacctccgtctcccaggttcaagcaa

SEQ ID NO: 3481 - DNA, 201 bp, Homo sapiens; identical to SEQ ID NO: 751

SEQ ID NO: 3482 - DNA, 201 bp, Homo sapiens
gcatgcagtcctgagtccccagataggtgaatattgtaacacatacctttcccgaaatatgtttctgggatgctgagcagagaatagtctccttgtgatgyggatgccgggtgtttggccagcctcaatcaccagctcaggtgccactgcctcacacagtcacttagggtcattggtttaggttatcattctacagcattt

SEQ ID NO: 3483 - DNA, 201 bp, Homo sapiens
gagcaaagattcgactgtcaatcacactttgacttgcaccaaaataccacctatgaactatgtgtcaaaggtttgaagagcaccaaattttcttaactctrtataaaaattaagttgtaatgagctgttacgagtaacctgtatccacaatagaggcccaaagcagccccctctgcatttgtgtgccgtccctggacggat

SEQ ID NO: 3484 - DNA, 201 bp, Homo sapiens
tttttttttttgagatggagtctcgttctgttgcccaggctggagtgcagtggcacaatctcggctcacttcaacctccgtctcccaggttcaagcaattstcctgtctcagcctcctgagtagctgggactacaggtgcatgccactacgtctggctaatttttgtatttttagtagggatgggatttcaccatattggt

SEQ ID NO: 3485 - DNA, 201 bp, Homo sapiens; identical to SEQ ID NO: 755

SEQ ID NO: 3486 - DNA, 201 bp, Homo sapiens; identical to SEQ ID NO: 759

SEQ ID NO: 3487 - DNA, 201 bp, Homo sapiens
gcactgaatttctctcatttgtagctagttgccctttcaatgttccaaaaaaaaaggctgtaaataacttattttatttattcaattaatttttttttttwaattttttgagatatagtttccctctggtcacccaggctggagtgaaatgatgcaatctcggcttactgcaatttctgcctcccgggttcaagcaattct

SEQ ID NO: 3488 - DNA, 201 bp, Homo sapiens
aatcacttgaacctgggaggcggaggttgcagtgagccgagatggtgccactgcactccagcctgggtgacagagcgagactccatctcaaaaaaaaaaamcccccccacacacaaaacctgttttcttgaatcatggttgttttgttactgataggttcaataagtaaatatatttattgtctgttgtattctttattag

SEQ ID NO: 3489 - DNA, 201 bp, Homo sapiens
tattaggcattataaacacaccgccactttttaatttttatttcattaatgtttccaattttttttttttttttttttaagacagaggctcgctctgtcayccaggctggagtggagtggtgcagtcttaccccactgcaacctccacctcctgggctcagccttgtaaatagctgggactacaggcatgcaccaccatgc

SEQ ID NO: 3490 - DNA, 201 bp, Homo sapiens
ctctatataaaaattaagttgtaatgagctgttacgagtaacctgtatccacaatagaggcccaaagcagccccctctgcatttgtgtgccgtccctggayggattcgagagtcaaccaggcctgcctctgagccattcctgtgtatttcctcagcacctccctgcttggctgcttccccttcaggcagaacacagtactg

SEQ ID NO: 3491 - DNA, 201 bp, Homo sapiens
ttttgagatcgtgattatggtgctgaaggacaaattccaggtaggttttggagagggacaggttgagtcctcattagtgagcaggagtgcacaggggtgcytttcacatttgtgagcccagccttatatttcctacacctgagatatagtttgtttggctttgtagtttttctccataaaaggaccaggaaggcacctaaa

SEQ ID NO: 3492 - DNA, 201 bp, Homo sapiens; identical to SEQ ID NO: 762

SEQ ID NO: 3493 - DNA, 201 bp, Homo sapiens
cttcaacccctgggagaataactgcaatttaaaaatgcgctgttattaatggagaaagtgaggtcttaccgactggcacgttcacacctcacagacagaayagaatcttagcattctgggggcaccctggaaaggacaactaagacacgtttgaagttcatgtagtgctgggtgaaggtggtggctcaggcctgtagtccc

SEQ ID NO: 3494 - DNA, 201 bp, Homo sapiens
cctgggctgctttctcacctgttccctcctagcctgaggccgagcgccacctccaagtggaggaatctggggaagtttccttcccggaatttgtagtgacrgtggagtgacctccattgcgttccctgcctctaacacgctctttaggatgccgagtcatttgactgcagtgttaaacattgcaaagcgcaagtcatgtga

SEQ ID NO: 3495 - DNA, 201 bp, Homo sapiens
ctgctggtcctttactggtggctttcctttctgagcactcatggggcccctgtgtcttccctcatatagattccaggtggatctgcagaatggcagcagcrtgaaacctcgagccgatgtggcctttcatttcaatcctcgtttcaaaagggccggctgcattgtttgcaatactttgataaatgaaaaatggggacggga

SEQ ID NO: 3496 - DNA, 201 bp, Homo sapiens
gtggtgtttgcggggaaacagagctggacaaaaggcaagtgcttgctgacttctaaggcagtttccagtagccttccctgagcacttcacttccatcttaycagcagagctttagctgcacaggcaggcctagctgcgagggaggctgggaaaggtaggtttttattctgggcagattcagacccagttcaaactcagggg

SEQ ID NO: 3497 - DNA, 201 bp, Homo sapiens
actgtttccctacagcctagtaatagaggaggagacatttctaaaatcgcacccagaactgtctacaccaagagcaaagattcgactgtcaatcacacttwgacttgcaccaaaataccacctatgaactatgtgtcaaaggtttgaagagcaccaaattttcttaactctatataaaaattaagttgtaatgagctgtta

SEQ ID NO: 3498 - DNA, 201 bp, Homo sapiens
tcacttctgtgctttgggtagctggatgggtgcatgtggtgtttgcggggaaacagagctggacaaaaggcaagtgcttgctgacttctaaggcagtttcyagtagccttccctgagcacttcacttccatcttaccagcagagctttagctgcacaggcaggcctagctgcgagggaggctgggaaaggtaggtttttat

SEQ ID NO: 3499 - DNA, 201 bp, Homo sapiens
agatttccagccctcacttctgtgctttgggtagctggatgggtgcatgtggtgtttgcggggaaacagagctggacaaaaggcaagtgcttgctgacttytaaggcagtttccagtagccttccctgagcacttcacttccatcttaccagcagagctttagctgcacaggcaggcctagctgcgagggaggctgggaaa

SEQ ID NO: 3500 - DNA, 201 bp, Homo sapiens
cttccatgtttatccttttctgcttagtattctaagtactccttttttaccttacaatttagtcttaaaacacaacacagtcaagtctttcttttgtaacytgtgagataccttctagcctttgtgctgtttttcttctctttttgctgcctgccttcctgactgagagtggatttcctcactaaggctctgccctctgat

SEQ ID NO: 3501 - DNA, 201 bp, Homo sapiens
caaatgccaaaaggtcagtatccttcggtaccagtcacagtgcagatacttccgtgcctgttaccgccttccacccgtgaacggtcctgtgagctggaagwagggctagcgtcagaatcttcatttccaaagtgagatgattcaagcaggaggtggttagattgtgaacagccagtgggcagcagagccgactaaggccgt

SEQ ID NO: 3502 - DNA, 201 bp, Homo sapiens
gaggcgcacacaagcacacgcacatatacttatgactgcctgtttgtctggggagagacagttcctggtgcttaatcaaatcaggaactcaaaagaagttyggaagcactgctagtgttttgggtgctttcggttaccatttggtcatgtgtgtggagacctgtgggaacaggtataaaactggacgcaaggaaacattta

SEQ ID NO: 3503 - DNA, 201 bp, Homo sapiens
gcacacgcacatatacttatgactgcctgtttgtctggggagagacagttcctggtgcttaatcaaatcaggaactcaaaagaagtttggaagcactgctrgtgttttgggtgctttcggttaccatttggtcatgtgtgtggagacctgtgggaacaggtataaaactggacgcaaggaaacatttaaatttggataata

SEQ ID NO: 3504 - DNA, 201 bp, Homo sapiens
ctggggagagacagttcctggtgcttaatcaaatcaggaactcaaaagaagtttggaagcactgctagtgttttgggtgctttcggttaccatttggtcaygtgtgtggagacctgtgggaacaggtataaaactggacgcaaggaaacatttaaatttggataataagttaatttattaactgtttttttttggtggcgg

SEQ ID NO: 3505 - DNA, 201 bp, Homo sapiens
gtgcctgttaccgccttccacccgtgaacggtcctgtgagctggaagaagggctagcgtcagaatcttcatttccaaagtgagatgattcaagcaggaggwggttagattgtgaacagccagtgggcagcagagccgactaaggccgtgttctgacctcggctttttctggccagacaagagagtagcatttttgtccacg

SEQ ID NO: 3506 - DNA, 201 bp, Homo sapiens
ttgcatagaaaatgaacagtttaaaccgtggagggcagcttcattcattccattccttactgtagaactgtttccctacagcctagtaatagaggaggagrcatttctaaaatcgcacccagaactgtctacaccaagagcaaagattcgactgtcaatcacactttgacttgcaccaaaataccacctatgaactatgtg

SEQ ID NO: 3507 - DNA, 201 bp, Homo sapiens
tcaggaactcaaaagaagtttggaagcactgctagtgttttgggtgctttcggttaccatttggtcatgtgtgtggagacctgtgggaacaggtataaaaytggacgcaaggaaacatttaaatttggataataagttaatttattaactgtttttttttggtggcggggggggctctgtcttctgtatctctctaggtgg

SEQ ID NO: 3508 - DNA, 201 bp, Homo sapiens
catggctctgaaacattccgtagtgttctttggacacgagttttccctggagatcgctttctgcaggcctcttggtcctgactgtggcttcttttcagagsctgccattcgctgcaaggttgaacacccccatgggccctggacgaactgtcgtcgttaaaggagaagtgaatgcaaatgccaaaaggtcagtatccttcg

SEQ ID NO: 3509 - DNA, 201 bp, Homo sapiens
gattctgagatttatgtgcagccttaaaaagtgtagtttttctctatcaataatgagtgtgggttgtaattgcttagtaagtaattttgtttatgtaaacrtacatttgttaaattttttttcttaggtaatcccgtatgttggcaccattcctgatcagctggatcctggaactttgattgtgatacgtgggcatgttcc

SEQ ID NO: 3510 - DNA, 201 bp, Homo sapiens
tccaaaccagtggcttttccttttaaaaaaatttaaagataatatgtgcaaatcatttttttaaaattcaaacagtatttaagagtttcagtgaaacatgmattttccttctaccctggtacttagttttactccccaagggcaatcactttttactggtttttaaaaatatatccttcctgagatacttatgaatatcca

SEQ ID NO: 3511 - DNA, 201 bp, Homo sapiens
agacaggggttcaccatgttggccaggctggtctggaactcctgacctcaagtgatccgcccacttcgccctcccagtgctgggattacaggtgtgagtcrccacgcccagcccaggcaacattttttagggcccctcttgtcatgtgatttagaaaatttctgctttaacaactttttccacagacgtccagccttctga

SEQ ID NO: 3512 - DNA, 201 bp, Homo sapiens
actacaggcgcccgccacccacgcctggctaatttttttgtatttttagtagagacggggtttcaccatgttagccaggatggtctcgatctcctgacctygtgatccacccatctcagcctcccaaagtgctgggattacaggcgtgagccaccgcgcccggccccattttattacctttatttgcttggatccttctta

SEQ ID NO: 3513 - DNA, 201 bp, Homo sapiens
gaatacctgcttgagaggatcccaggctcctgcagcctgaagtagtcattcagtttagcgttaaaccttccatttctgtccaaccacatctcagcctcaaygctgattttaaagggttttttttttcgtatttttattttgcaagtaacgaattagtggaatgctgactgggtttaaaatttcaacttcacctgcattccc

SEQ ID NO: 3514 - DNA, 201 bp, Homo sapiens
catgactgtctttgcattgaaaattttgatagatactaactcgcccttcacaagggtaaaaacagtttgcactctcaacagccatgctcccaccttcttgytgacattacatcttattctctgtaatgtttgccaatctgatggggggcggaaaggaccacagtgtcaagtgtatttttggatcatagttttcaagcatat

SEQ ID NO: 3515 - DNA, 201 bp, Homo sapiens
tttagtagagacggggtttcaccatgttagccaggatggtctcgatctcctgacctcgtgatccacccatctcagcctcccaaagtgctgggattacaggygtgagccaccgcgcccggccccattttattacctttatttgcttggatccttcttagcttcttcaatgttaaagatattgacagttttcctcttactgaa

SEQ ID NO: 3516 - DNA, 201 bp, Homo sapiens; identical to SEQ ID NO: 750

SEQ ID NO: 3517 - DNA, 201 bp, Homo sapiens
aggatggtctcgatctcctgacctcgtgatccacccatctcagcctcccaaagtgctgggattacaggcgtgagccaccgcgcccggccccattttattayctttatttgcttggatccttcttagcttcttcaatgttaaagatattgacagttttcctcttactgaaatttataaatccattgactcccttgatattat

SEQ ID NO: 3518 - DNA, 201 bp, Homo sapiens
tttgcaatactttgataaatgaaaaatggggacgggaagagatcacctatgacacgcctttcaaaagagaaaagtcttttgagatcgtgattatggtgctraaggacaaattccaggtaggttttggagagggacaggttgagtcctcattagtgagcaggagtgcacaggggtgcttttcacatttgtgagcccagcctt

SEQ ID NO: 3519 - DNA, 201 bp, Homo sapiens; identical to SEQ ID NO: 754

SEQ ID NO: 3520 - DNA, 201 bp, Homo sapiens
tctcagatgctctgccaacgcttcacaccaagtattacaaactaaactcgtcatcttcctcctgaaacctgtctcccaggccaggcgcggtggctcacacytgtaatcccagtactttgggaggccgaggtgggtggatcacctgaggtcaggagttcgagaccagcctggccaacttggtaaaaccccatctctacgaaa

SEQ ID NO: 3521 - DNA, 201 bp, Homo sapiens
tatcttcttcataaactgtctttggctacctcagttagaattccttatcccattttcctgaagcatttctttgactcttctttactgctcccccacccttttttttttttctttgagactgaattttgcttgttgcccaggctggagtgcaattgcccgatctcggctcattgcaacctccgcctcctgggttcaagtgat

SEQ ID NO: 3522 - DNA, 201 bp, Homo sapiens
ggtatttaagagcatctaataggcacagaattgtgctccatactgcttaaactgttccctaagtgtccaatttggagaaaacacccacacgcaggataacyggcgagtgacgcggagtggctgcgagtccaagttatcactaacggatggggagcttgggctgggcacagtccagcgtactgaacccttcccccaccgttt

SEQ ID NO: 3523 - DNA, 201 bp, Homo sapiens
tttcctgaagcatttctttgactcttctttactgctcccccacccttttttttttttctttgagactgaattttgcttgttgcccaggctggagtgcaatkgcccgatctcggctcattgcaacctccgcctcctgggttcaagtgattctcctgcctcagcctcctgagtagctgggattacagtcatgtgccaccatgc

SEQ ID NO: 3524 - DNA, 201 bp, Homo sapiens
cctcctgggttcaagtgattctcctgcctcagcctcctgagtagctgggattacagtcatgtgccaccatgcccggctaattttgtatttttagtagagayggggtttctccacgttggtcaggctggtcttcaactcccaacctcaagtgatctgcccaccttcgcctcccaaaatgctgggattacaggtgttagccac

SEQ ID NO: 3525 - DNA, 201 bp, Homo sapiens
gtgaggttacagtttttgaaaatgggacagcaataagaatcctgggagcaggggtgggataagtggtccatttaaatcaagtcctaactcagtatgtggargttgtgtatgttttttgtttacttggagattgtaatttgcccctttttataacgtgggcaatcagtataaatggcaaagccagtagagtgtcaaattatg

SEQ ID NO: 3526 - DNA, 201 bp, Homo sapiens
tctccacgttggtcaggctggtcttcaactcccaacctcaagtgatctgcccaccttcgcctcccaaaatgctgggattacaggtgttagccactgcgccygacccccattttttttttttaaagatgttgaattggtcagggtttgtagttacaagcaacagaagccaactctttaagcagaaaaggaatttgctaaatg

SEQ ID NO: 3527 - DNA, 201 bp, Homo sapiens
catttgtaagaaattcttttcttcaggagtcctggggagaagaagagagaaatattacctctttcccatttagtcctgggatgtactttgaggtgaggttmcagtttttgaaaatgggacagcaataagaatcctgggagcaggggtgggataagtggtccatttaaatcaagtcctaactcagtatgtggaagttgtgta

SEQ ID NO: 3528 - DNA, 201 bp, Homo sapiens
aaaggtcagtatccttcggtaccagtcacagtgcagatacttccgtgcctgttaccgccttccacccgtgaacggtcctgtgagctggaagaagggctagygtcagaatcttcatttccaaagtgagatgattcaagcaggaggtggttagattgtgaacagccagtgggcagcagagccgactaaggccgtgttctgacc

SEQ ID NO: 3529 - DNA, 201 bp, Homo sapiens
aactgtcgtcgttaaaggagaagtgaatgcaaatgccaaaaggtcagtatccttcggtaccagtcacagtgcagatacttccgtgcctgttaccgccttcyacccgtgaacggtcctgtgagctggaagaagggctagcgtcagaatcttcatttccaaagtgagatgattcaagcaggaggtggttagattgtgaacagc

SEQ ID NO: 3530 - DNA, 201 bp, Homo sapiens
aactgacacattgtctggaccatgtgggttcttgaggactcatcaaaactcgttactaaaagcatgaatatcaggcggaatagatagcaatgtgacattcrtatttatccctaagttccagtctaatgcagtgccctggtatgtggagtgtagacagatgtgggctaatcatggaaggttccctgaagttgtggatattgg

SEQ ID NO: 3531 - DNA, 201 bp, Homo sapiens
caaacaaacagaatccaaagtgctatcatgaaccctctgagaggggctgactcagcagcccagggagcttgaagaaggctccacagaggaggctgtgcctsaaggcgatttcggtttaggagccaccaatttataaccacttttctgtggcccgtcttattttatttcttatttcttgacaatcagaagtaccttgggtag

SEQ ID NO: 3532 - DNA, 201 bp, Homo sapiens
ccatcatcccccatgaaaactattgttatcatttttgtctgatttctttagtgtttctctttttctttttttaatttttaatttttttgagtatgtagtakgtatatctatttatggggtatatggcatattttgatacaggatacagtgtgtattagcaaggttttctttttaatgtttatatttatttagttgagatca

SEQ ID NO: 3533 - DNA, 201 bp, Homo sapiens
gtgtagtgtccatgagtgcttttatcttaaaaaatgtggctgatgctttccaacactcccctgccctgtgattattatttttttaagcaacagagaaaacygtatcttaatagtattaaaagtattggatttttccctactttgatttgtttaaattggaggaggaagagcaattctttctattcacaataataatagcta

SEQ ID NO: 3534 - DNA, 201 bp, Homo sapiens
tttggtcccagaagcttacacctgctggccctctggcctgtggagcttgcccacagtagaggtatgtaccaacgcgagagaagactcgaatgcctctggcrcagatcctttctgatcttcgggatactgctcctgcccgaaagtctttctgaatctcccaaactccattcacctctcccttctctggccttttgagcccgt

SEQ ID NO: 3535 - DNA, 201 bp, Homo sapiens
ccactgctgtctctgaccccagatgtagctccctctgaccctggatgcagctccctctgaccctcgatatagctgcccctgaccccggatgtagctgcctytgaccccagatgtagctttctccaaacccagatatagcggctgcccccttgccagagtgaatactgcgtcattgtggcttcttcttgtcactggttctta

SEQ ID NO: 3536 - DNA, 201 bp, Homo sapiens
gccactgctgtctctgaccccagatgtagctccctctgaccctggatgcagctccctctgaccctcgatatagctgcccctgaccccggatgtagctgccyttgaccccagatgtagctttctccaaacccagatatagcggctgcccccttgccagagtgaatactgcgtcattgtggcttcttcttgtcactggttctt

SEQ ID NO: 3537 - DNA, 201 bp, Homo sapiens
ttttcctctatttttactttacacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaactgatttctataagataactttt

SEQ ID NO: 3538 - DNA, 201 bp, Homo sapiens
attacctcccaaagcaaccccagtactttgggaggatcactttgagcccaggagttccagaccagcccggccaacatggcaaaaccccatctctctaaaastacaaaaaattagctgggcatggtggcacatgcctgtagtcccagctacttggatggctgaggcaggagaatcgcttgaacccgggaggcagaggttgca

SEQ ID NO: 3539 - DNA, 201 bp, Homo sapiens
ttgatacaggatacagtgtgtattagcaaggttttctttttaatgtttatatttatttagttgagatcatactatatatggctctatagattactttctcacttatattactaacttgtgttattaaatattctgcataaagataattttaagatgaaatttgatgttataaaaacttctcattttattaagagattaacg

SEQ ID NO: 3540 - DNA, 201 bp, Homo sapiens
aatggtttactctgacaccgttagcatgtaacaaacacaaaattttaaactaaggggaaccactaatggcatgtatcctttcctttcagatgataatttaytgtgatgttagagaattcaaggttgcagtaaatggcgtacacagcctggagtacaaacacagatttaaagagctcagcagtattgacacgctggaaatta

SEQ ID NO: 3541 - DNA, 201 bp, Homo sapiens
gtgtgtattagcaaggttttctttttaatgtttatatttatttagttgagatcatactatatatggctctatagattactttctcacttatattactaacwtgtgttattaaatattctgcataaagataattttaagatgaaatttgatgttataaaaacttctcattttattaagagattaacgctatgaaacctgctg

SEQ ID NO: 3542 - DNA, 201 bp, Homo sapiens
agtgaaagggatggctggctgaaggaatgaatagatgaatgttatatgcttttgaacaatcgtcttttccatttaattttctaattcaggagcagtaattrtccttgtgttgatcactgctgacgattttctatactgataggtcctttccgggggcttccatctcttgccttttaaatatgcttgcattgagattatctc

SEQ ID NO: 3543 - DNA, 201 bp, Homo sapiens
gcagccacatagcacaggtccccagccagtggactgggaagacagtgtagtcatctctggggaaggggaatgacaagatctggcagtgtggcaggtcccasaaaaaaagggctgggttctgggcagtgagggtgcaggttgagacctgaatactgggtggagccagctgtcagagtccacgcctgcagactggactggtcc

SEQ ID NO: 3544 - DNA, 201 bp, Homo sapiens
agtgggtggaaacccagcctggcactggcagcgtggcaccagaagtatgaagtgtaggtgtaaaggtgatgtaaaaggctagtaggttttttggtttttcrttgtttgagttttgggcatagatgactgtgaagggcgaacactgccgatggatcaatgaatttgtagtatgtgcaccacttccaacttacgggataccca

SEQ ID NO: 3545 - DNA, 201 bp, Homo sapiens
ccaaatacaaaatactatgaatagtatttaccttgtgtctctttccaaagaactcatagtggtttgcagctattgcagatatcctggccatgaggtatgcrgttcctttttttttttttgagacggagccttgctctgtcgcccaggctggagcatagtggcgcgatctcggctcactgcaagctccgcctcccgggttcg

SEQ ID NO: 3546 - DNA, 201 bp, Homo sapiens
cctccccttcctgattttccttgacagtcctttccactgctcctatcaaaagaatggaaaccctcaacttgctgctttgcagattcaggttttgtgcttcwttctggcctctcggggtggggccgggttagcagcaaggctgagctgcccctctttcttctgaagccttcatgggggcgaggagcacagggagagctcagt

SEQ ID NO: 3547 - DNA, 201 bp, Homo sapiens
ctctttcgctgttttattaactcaatcctcagaacaaaccaatgatgtgaatactgtaattctcattttatggaaatgaaaatctaaatgaatacctctgrtaattgtacgggactgtttgattagtatttaccattaattaattaaattttttttttttttgagatggagtctcgttctgttgcccaggctggagtgcag

SEQ ID NO: 3548 - DNA, 201 bp, Homo sapiens
gatggtctcgatctcctgacctcgtgatcctcctgcctcggcctcccaaagtgctgggattacaggcgtgagccaccgcgcccggccgcagttcctttttmtagctgtttgaataggaaagatgacttggaaaatgctggattctgagatttatgtgcagccttaaaaagtgtagtttttctctatcaataatgagtgtgg

SEQ ID NO: 3549 - DNA, 201 bp, Homo sapiens
agctaacatagcgcttactctttcgctgttttattaactcaatcctcagaacaaaccaatgatgtgaatactgtaattctcattttatggaaatgaaaatytaaatgaatacctctggtaattgtacgggactgtttgattagtatttaccattaattaattaaattttttttttttttgagatggagtctcgttctgttg

SEQ ID NO: 3550 - DNA, 201 bp, Homo sapiens
atttcattgctgtaagtctgatttcagtataaaaaattagaactatcagctggatgtggtgacttaaacatacttttccagcactttgggaggccaaggcrggaggattgtttgaggccaggagtttgagaccagcctgggcaacatagtgagaccccccatctgtaaaaaaaaaaaaaatttaaaaattaactggcttgg

SEQ ID NO: 3551 - DNA, 201 bp, Homo sapiens
gtataaaaaattagaactatcagctggatgtggtgacttaaacatacttttccagcactttgggaggccaaggcaggaggattgtttgaggccaggagttygagaccagcctgggcaacatagtgagaccccccatctgtaaaaaaaaaaaaaatttaaaaattaactggcttggtggtgtgcgcctgtagttgtagctac

SEQ ID NO: 3552 - DNA, 201 bp, Homo sapiens
aactggcttggtggtgtgcgcctgtagttgtagctactcagggggctgaggtaggaggattccttgagcccaggagtttgaggttgcagtgagctgtgatsgagccactgcactatagcctgggtgacaaaaaaaaaaaagaaaaagaaaaagaattaggtatgtcattaaagaaaggaattgtggtcagatgacagggac

SEQ ID NO: 3553 - DNA, 201 bp, Homo sapiens
tgaaacatataattaaaaatatttttctggctatagaaatatcgatgcttattatagacatctgcaaagtatgaaaatatatgaagaaaaaaattaaaatsccatcatcccccatgaaaactattgttatcatttttgtctgatttctttagtgtttctctttttctttttttaatttttaatttttttgagtatgtagta

SEQ ID NO: 3554 - DNA, 201 bp, Homo sapiens
atgtgtgtggagacctgtgggaacaggtataaaactggacgcaaggaaacatttaaatttggataataagttaatttattaactgtttttttttggtggcggggggggctctgtcttctgtatctctctaggtggctgtaaatggaaaacatactctgctctatggccacaggatcggcccagagaaaatagacactctgg

SEQ ID NO: 3555 - DNA, 201 bp, Homo sapiens
cctgctggtcctttactggtggctttcctttctgagcactcatggggcccctgtgtcttccctcatatagattccaggtggatctgcagaatggcagcagyatgaaacctcgagccgatgtggcctttcatttcaatcctcgtttcaaaagggccggctgcattgtttgcaatactttgataaatgaaaaatggggacggg

SEQ ID NO: 3556 - DNA, 201 bp, Homo sapiens
aaaaaaaaaaaaaaagtgatgggaatagattgttttgtctcaaaaagctctttccaacactaaaatgaaacatataattaaaaatatttttctggctataraaatatcgatgcttattatagacatctgcaaagtatgaaaatatatgaagaaaaaaattaaaatcccatcatcccccatgaaaactattgttatcatttt

SEQ ID NO: 3557 - DNA, 201 bp, Homo sapiens
aaagctgggaaggatgtggaaggctgaaggttggcttttctagatttagggcatgatttgaacaagtccttagaggtgggaagggcagcacagggttgttrgcttggcaagagtcaaggcgcaaagggtgacttggggttcactggagggaaacagaggtgagtgctctagaaggaagttgagccttgtggtgggtgacag

SEQ ID NO: 3558 - DNA, 201 bp, Homo sapiens
aaggctgaaggttggcttttctagatttagggcatgatttgaacaagtccttagaggtgggaagggcagcacagggttgttagcttggcaagagtcaaggygcaaagggtgacttggggttcactggagggaaacagaggtgagtgctctagaaggaagttgagccttgtggtgggtgacaggaaaccaatgatgtaactt

SEQ ID NO: 3559 - DNA, 201 bp, Homo sapiens
tgaacaagtccttagaggtgggaagggcagcacagggttgttagcttggcaagagtcaaggcgcaaagggtgacttggggttcactggagggaaacagagrtgagtgctctagaaggaagttgagccttgtggtgggtgacaggaaaccaatgatgtaacttgtttttgacctatctgggccccaagtttggatctgctat

SEQ ID NO: 3560 - DNA, 201 bp, Homo sapiens
gggccccaagtttggatctgctatattaatataaaaaaggataataatgatacattcaaataatgctgaaaaatactaagatgaaaatacctccaacttcrtaattcaaaccataccattaggattaggtgaaccacattccaggcatttttttgcagagacagtgaaagggatggctggctgaaggaatgaatagatgaa

SEQ ID NO: 3561 - DNA, 201 bp, Homo sapiens
atgatacattcaaataatgctgaaaaatactaagatgaaaatacctccaacttcataattcaaaccataccattaggattaggtgaaccacattccaggcrtttttttgcagagacagtgaaagggatggctggctgaaggaatgaatagatgaatgttatatgcttttgaacaatcgtcttttccatttaattttctaat

SEQ ID NO: 3562 - DNA, 201 bp, Homo sapiens
aaaatactaagatgaaaatacctccaacttcataattcaaaccataccattaggattaggtgaaccacattccaggcatttttttgcagagacagtgaaarggatggctggctgaaggaatgaatagatgaatgttatatgcttttgaacaatcgtcttttccatttaattttctaattcaggagcagtaattatccttgt

SEQ ID NO: 3563 - DNA, 201 bp, Homo sapiens
ttgttctgttttcttctaggcaaaggatgtgccttcttttcatttgcagtagtctgctcacccggaagcatgtcatttctttgccacttgcttgtaattcrctggctttgcacttgctctgatacagtacaggtaactaattgactccctctgctgccaacttggttttccttctgagctatagcatcaggctgtgtgttt

SEQ ID NO: 3564 - DNA, 201 bp, Homo sapiens
gacggttcccatgaagaggcatctgttgtcaccactggacacagatggtactgtgtctctgctactctaccaatgccactgctgtctctgaccccagatgyagctccctctgaccctggatgcagctccctctgaccctcgatatagctgcccctgaccccggatgtagctgcctttgaccccagatgtagctttctccaa

SEQ ID NO: 3565 - DNA, 201 bp, Homo sapiens; identical to SEQ ID NO: 773

SEQ ID NO: 3566 - DNA, 201 bp, Homo sapiens
gggacagtgctgctgcaggggacccagctgggaccaaggcagactgtctctcccctcctgggatttacagggtcatggctctgaaacattccgtagtgttstttggacacgagttttccctggagatcgctttctgcaggcctcttggtcctgactgtggcttcttttcagaggctgccattcgctgcaaggttgaacacc

SEQ ID NO: 3567 - DNA, 201 bp, Homo sapiens
ttaataaaacacacacagtttttagctgggtagcagctatttcctttgcatgggcataaaatggagtatttctgtaagacaggttcctaggctgggagtgyctgagtcaaagagcacagtcatgtgttgcataaggacagttcagtcaaagatgaaccacatatacaaccgtggtcccataagattgtcatatactgtatt

SEQ ID NO: 3568 - DNA, 201 bp, Homo sapiens
atccaaaattatttagtatatgagcacactggtaagaatgggaggcagatcgttgattgtaataatattctattatttggtaaatatcagtaacataatayataatttaaattttaaaataggatatgaagaaaaatgctacatgcttacttttcttttcctctatttttactttacacagggccagtgcctcagtttcaa

SEQ ID NO: 3569 - DNA, 201 bp, Homo sapiens
gccctttcactcagccccgtttgcacctaaatatgacttacaaaagaaacacagcatttatgtgtacttatttcaacttattttagctttgtaaagaagtrcaaggttgactcagggcccagcttggtgtctcatgcctgtaatttcagcattgtgggaggccaaggcaggaagatattgtgagcccaggagtttgagacc

SEQ ID NO: 3570 - DNA, 201 bp, Homo sapiens
gagtagctgggactacaggcgcccaccaccacacccggctaatttttgtatttttagtagagacggggtttcaccgtgttagccaggatggtctcgatctsctgacctcgtgatcctcctgcctcggcctcccaaagtgctgggattacaggcgtgagccaccgcgcccggccgcagttcctttttatagctgtttgaata

SEQ ID NO: 3571 - DNA, 201 bp, Homo sapiens
cgcccaccaccacacccggctaatttttgtatttttagtagagacggggtttcaccgtgttagccaggatggtctcgatctcctgacctcgtgatcctccrgcctcggcctcccaaagtgctgggattacaggcgtgagccaccgcgcccggccgcagttcctttttatagctgtttgaataggaaagatgacttggaaaa

SEQ ID NO: 3572 - DNA, 201 bp, Homo sapiens
ggctggaacttttctatgtataatcaaatggtttactctgacaccgttagcatgtaacaaacacaaaattttaaactaaggggaaccactaatggcatgtwtcctttcctttcagatgataatttattgtgatgttagagaattcaaggttgcagtaaatggcgtacacagcctggagtacaaacacagatttaaagagct

SEQ ID NO: 3573 - DNA, 201 bp, Homo sapiens
gtttcatagagttagaatcatagttcaagtctggtcactaacattgctgaaattgccactactctgtcctacttggttaattaaggtttttttttttcttyctttctcaaaagctttaatgttgacctactagcaggaaaatcaaaggatattgctctacacttgaacccacgcctgaatattaaagcatttgtaagaaat

SEQ ID NO: 3574 - DNA, 201 bp, Homo sapiens
tttttctggccagacaagagagtagcatttttgtccacgaggcctatccttgccttgtagaactccagagcagccccgtaagatcaggcaacatcttttcttttttttttttgagatggagcctcactgtgtcacccaggctggagtgcagtgtcacaatcccagcacaccacaacctccgcttcctgggtgttcaagcca

SEQ ID NO: 3575 - DNA, 201 bp, Homo sapiens
agaggatcccaggctcctgcagcctgaagtagtcattcagtttagcgttaaaccttccatttctgtccaaccacatctcagcctcaacgctgattttaaagggttttttttttcgtatttttattttgcaagtaacgaattagtggaatgctgactgggtttaaaatttcaacttcacctgcattcccatgtccatgtgga

SEQ ID NO: 3576 - DNA, 201 bp, Homo sapiens
atgtggatacgtgtgtttcatagagttagaatcatagttcaagtctggtcactaacattgctgaaattgccactactctgtcctacttggttaattaaggtttttttttttctttctttctcaaaagctttaatgttgacctactagcaggaaaatcaaaggatattgctctacacttgaacccacgcctgaatattaaag

SEQ ID NO: 3577 - DNA, 201 bp, Homo sapiens
acagaagcttcatcttggccagctgttatcagagtgcaggacttgggctgaaatttcctccccttcctgattttccttgacagtcctttccactgctccthtcaaaagaatggaaaccctcaacttgctgctttgcagattcaggttttgtgcttcattctggcctctcggggtggggccgggttagcagcaaggctgagc

SEQ ID NO: 3578 - DNA, 201 bp, Homo sapiens
atttcagcattgtgggaggccaaggcaggaagatattgtgagcccaggagtttgagaccagcccgggcaacacagtggaccctgtctctacaaaaaaaaawttttaaattagctgggcatagtggtgtgcgtctatagtcccagctactcctggggctgaggtgggaggatcacttgagggaaaccctgtctcaaagtggc

SEQ ID NO: 3579 - DNA, 201 bp, Homo sapiens
aattattgagttggagcacattttcccagcacttagcaccgctatttcatggatggttggagagggggtccaaaaattttacaatcatgttaacaaaagtracacagcaacaaaacaataagcaaaatcactgccagagtattccttagcttgaaacaatacggttcacgtcgatagaatatggcatctatttctgtttaa

SEQ ID NO: 3580 - DNA, 201 bp, Homo sapiens
aggtgtaaaggtgatgtaaaaggctagtaggttttttggtttttcattgtttgagttttgggcatagatgactgtgaagggcgaacactgccgatggatcdatgaatttgtagtatgtgcaccacttccaacttacgggatacccagctttgacggctttggacaaacacactgaggccaagatgtgctgagcttatcagg

SEQ ID NO: 3581 - DNA, 201 bp, Homo sapiens
tctcctgtctcagcctcctgagtagctgggactacaggtgcatgccactacgtctggctaatttttgtatttttagtagggatgggatttcaccatattgstcaggctggtctctaactcctgaacctcaggtgatccacccgccttggcctcccaaagtgctgggattacaggtgtgagccaccatgcctggcctatttt

SEQ ID NO: 3582 - DNA, 201 bp, Homo sapiens
cagaagtaccttgggtaggttttaccatgcacatcgtaatttgagtgagcttagtgtgaggcttaacggtgtgtgggctgtacatcctggtcagatgctcyagatggaggcagatggttgtgatgcaggagaggcagccacatagcacaggtccccagccagtggactgggaagacagtgtagtcatctctggggaagggg

SEQ ID NO: 3583 - DNA, 201 bp, Homo sapiens
taacttgtattccaaaattattgagttggagcacattttcccagcacttagcaccgctatttcatggatggttggagagggggtccaaaaattttacaatyatgttaacaaaagtaacacagcaacaaaacaataagcaaaatcactgccagagtattccttagcttgaaacaatacggttcacgtcgatagaatatggca

SEQ ID NO: 3584 - DNA, 201 bp, Homo sapiens
ggtgtaaaggtgatgtaaaaggctagtaggttttttggtttttcattgtttgagttttgggcatagatgactgtgaagggcgaacactgccgatggatcaatgaatttgtagtatgtgcaccacttccaacttacgggatacccagctttgacggctttggacaaacacactgaggccaagatgtgctgagcttatcagga

SEQ ID NO: 3585 - DNA, 201 bp, Homo sapiens
gggatgggatttcaccatattggtcaggctggtctctaactcctgaacctcaggtgatccacccgccttggcctcccaaagtgctgggattacaggtgtgrgccaccatgcctggcctattttagtatttttaataataaattccatgttagaaattttctactgatgtattttttaagtcaatatttcctacactcacaa

SEQ ID NO: 3586 - DNA, 201 bp, Homo sapiens
ttcgagccagggacagtgctgctgcaggggacccagctgggaccaaggcagactgtctctcccctcctgggatttacagggtcatggctctgaaacattcygtagtgttctttggacacgagttttccctggagatcgctttctgcaggcctcttggtcctgactgtggcttcttttcagaggctgccattcgctgcaagg

SEQ ID NO: 3587 - DNA, 201 bp, Homo sapiens; identical to SEQ ID NO: 764

SEQ ID NO: 3588 - DNA, 201 bp, Homo sapiens
ggctgactcagcagcccagggagcttgaagaaggctccacagaggaggctgtgcctcaaggcgatttcggtttaggagccaccaatttataaccacttttstgtggcccgtcttattttatttcttatttcttgacaatcagaagtaccttgggtaggttttaccatgcacatcgtaatttgagtgagcttagtgtgaggc

SEQ ID NO: 3589 - DNA, 201 bp, Homo sapiens
tcttggccagctgttatcagagtgcaggacttgggctgaaatttcctccccttcctgattttccttgacagtcctttccactgctcctatcaaaagaatgraaaccctcaacttgctgctttgcagattcaggttttgtgcttcattctggcctctcggggtggggccgggttagcagcaaggctgagctgcccctctttc

SEQ ID NO: 3590 - DNA, 201 bp, Homo sapiens
tttgaagcttttacagattaaatgaagtctgagatttgcttcaaaatgaaccagtggtggggaggaagtgggtgaggtgtaggtgaaacaagattggccasgtcgataattgctggagctgggcgatgaaagcacaggtatttatcacaccatctctctacttttgtgtgtttttttgtttgtttttggttttggttttaa

SEQ ID NO: 3591 - DNA, 201 bp, Homo sapiens
aggcctgccagagcccactttccagacaggtgagagttcattcattcaccatgcagttaccgatcgtctcttgacctgtgtcctggggaggtaaaggtgaygagccagttctgccccatgcagctcacagtctaggcaaagctacatgcaaacaaacagaatccaaagtgctatcatgaaccctctgagaggggctgactc

SEQ ID NO: 3592 - DNA, 201 bp, Homo sapiens
gtgatccatctgcctcggcctcccaaagtgctgggattacaggcataagccaccgcgcccggcccatgtatactatttatacatttttagtatcattttgbctttacattttacataatttcagatacattttcctcatatcaaataattcagcattttttagtactaacatcatagtctgtaagccattcaaaaaatgta

SEQ ID NO: 3593 - DNA, 201 bp, Homo sapiens
tgggcaaggaaagaggacaatatagatgaaaaagaaattgatcctaccagaagtgatccttttatctgcataactctcaggcagttgtggcaaataattgscagtatctattgttctgaaactggttttcgcaacttttattgggaacaccatcccctctcctgcatgatcagtttctcctctccacggatcattcacatg

SEQ ID NO: 3594 - DNA, 201 bp, Homo sapiens
tcctcattagtgagcaggagtgcacaggggtgcttttcacatttgtgagcccagccttatatttcctacacctgagatatagtttgtttggctttgtagtytttctccataaaaggaccaggaaggcacctaaatgtgaggtatggcaccactactctccagccagttgttgccatgcagaaatatggtccactgtgacca

SEQ ID NO: 3595 - DNA, 201 bp, Homo sapiens
tccttttttaccttacaatttagtcttaaaacacaacacagtcaagtctttcttttgtaacctgtgagataccttctagcctttgtgctgtttttcttctytttttgctgcctgccttcctgactgagagtggatttcctcactaaggctctgccctctgatttttcactctcttttcttttttggttttactagtgaaat

SEQ ID NO: 3596 - DNA, 201 bp, Homo sapiens; identical to SEQ ID NO: 768

SEQ ID NO: 3597 - DNA, 201 bp, Homo sapiens
gtttatccttttctgcttagtattctaagtactccttttttaccttacaatttagtcttaaaacacaacacagtcaagtctttcttttgtaacctgtgagrtaccttctagcctttgtgctgtttttcttctctttttgctgcctgccttcctgactgagagtggatttcctcactaaggctctgccctctgatttttcac

SEQ ID NO: 3598 - DNA, 201 bp, Homo sapiens
gacaccactctcagcaaattcccctggttgtcccttctcagtctcatttattggcgttgtcttatctccccagggctgtccgaggtgattttctcccactrctctcctaggtggtgccatccaatctcatgatgtcatatcattcttccctcatgcttcagccatactggttggtggcctttgtttcctgaacacatttaa

SEQ ID NO: 3599 - DNA, 201 bp, Homo sapiens; identical to SEQ ID NO: 769

SEQ ID NO: 3600 - DNA, 201 bp, Homo sapiens
tttgttaactctgctctctggccctttcactcagccccgtttgcacctaaatatgacttacaaaagaaacacagcatttatgtgtacttatttcaacttaytttagctttgtaaagaagtacaaggttgactcagggcccagcttggtgtctcatgcctgtaatttcagcattgtgggaggccaaggcaggaagatattgt

SEQ ID NO: 3601 - DNA, 201 bp, Homo sapiens; identical to SEQ ID NO: 770

SEQ ID NO: 3602 - DNA, 201 bp, Homo sapiens
aaggacaaattccaggtaggttttggagagggacaggttgagtcctcattagtgagcaggagtgcacaggggtgcttttcacatttgtgagcccagccttrtatttcctacacctgagatatagtttgtttggctttgtagtttttctccataaaaggaccaggaaggcacctaaatgtgaggtatggcaccactactctc

SEQ ID NO: 3603 - DNA, 201 bp, Homo sapiens
gttgactcagggcccagcttggtgtctcatgcctgtaatttcagcattgtgggaggccaaggcaggaagatattgtgagcccaggagtttgagaccagccygggcaacacagtggaccctgtctctacaaaaaaaaatttttaaattagctgggcatagtggtgtgcgtctatagtcccagctactcctggggctgaggtg

SEQ ID NO: 3604 - DNA, 201 bp, Homo sapiens
aagcattacactatgcactggagactgtataagacaagttccttttctcaaactacagtcgagttggatagataaaacacacaacacataccaaaagacarctataaatccaaggcagtgtatgtcaagggtaaattcacctattcagattggatcttgagaagtgcatcaggcttggaaaatgggtaaggaggagagaaa

SEQ ID NO: 3605 - DNA, 201 bp, Homo sapiens
caaaagtgctgggattacaggcgtgaggcaccatgcctggccaacttagttatttaaagataatcaattagtatattttataagctagacttaggaaaackgttttcagctgggcatggtggctcacacctgtaatcccagcactttgggaggccgaggcaggtggatcacgaggtcaggagttcaagaccagcctggcca

SEQ ID NO: 3606 - DNA, 201 bp, Homo sapiens
atgaggcagacagtgccaccaccagggacactttagttagattagggtcttggaagtcagaaggaagtcagcagcagcaggctggaacttttctatgtatwatcaaatggtttactctgacaccgttagcatgtaacaaacacaaaattttaaactaaggggaaccactaatggcatgtatcctttcctttcagatgataa

SEQ ID NO: 3607 - DNA, 201 bp, Homo sapiens
cttcgggatactgctcctgcccgaaagtctttctgaatctcccaaactccattcacctctcccttctctggccttttgagcccgtgtctgtatcattcttyttcacagtttttaacagttgtgctttggctttacgtgtttattttgcctccacaatgggattttaagctccctgagtcagagactatattgtatgctgct

SEQ ID NO: 3608 - DNA, 201 bp, Homo sapiens
gatcttcgggatactgctcctgcccgaaagtctttctgaatctcccaaactccattcacctctcccttctctggccttttgagcccgtgtctgtatcattytttttcacagtttttaacagttgtgctttggctttacgtgtttattttgcctccacaatgggattttaagctccctgagtcagagactatattgtatgct

SEQ ID NO: 3609 - DNA, 201 bp, Homo sapiens
aaacagtttgcactctcaacagccatgctcccaccttcttgctgacattacatcttattctctgtaatgtttgccaatctgatggggggcggaaaggaccmcagtgtcaagtgtatttttggatcatagttttcaagcatatttttagtaccatttataatttttttatatgtcaatataaaatatttagaaaatattttc

SEQ ID NO: 3610 - DNA, 201 bp, Homo sapiens
agcagggtatgtgttctcggcgctcacaaatgtataatccattgtggcaaatttttgctttcacatatttttttttatcattattgtcacaggttctgtgrcggagttctggtttctaaattcacagcataccaaggcagttctttaaagttcttgatactcttttatcatatctaacttgtattccaaaattattgagtt

SEQ ID NO: 3611 - DNA, 201 bp, Homo sapiens
aaatggagtatttctgtaagacaggttcctaggctgggagtgcctgagtcaaagagcacagtcatgtgttgcataaggacagttcagtcaaagatgaaccrcatatacaaccgtggtcccataagattgtcatatactgtatttttaccataccttttctatgtttaggtaagtttatatgcacaaatacttaccatcctg

SEQ ID NO: 3612 - DNA, 201 bp, Homo sapiens
atggggctagtattggggtgtaggggagattaggtcaaagcaagaggattcaaaggagaaatgaattcctttagattggggaagataatcggaagaggtaraagacaccgtccatgacacttcctggggaagcagatgtatgtataaggatgtgagtattgtggttttgtaaagaatgcattcctgaagatgttgcataat

SEQ ID NO: 3613 - DNA, 201 bp, Homo sapiens
tctgagccattcctgtgtatttcctcagcacctccctgcttggctgcttccccttcaggcagaacacagtactgcctcagaccccaggcacagggggcctwcctggcgtgtttcactcatacagagggcatcgggtcccaccctgtcactcatttcatcgtctaaaatgtaatcatgtgtgtttgcttcgagccagggaca

SEQ ID NO: 3614 - DNA, 201 bp, Homo sapiens
agggtgaaaaaaaagagtttggtgctcatggatggggctagtattggggtgtaggggagattaggtcaaagcaagaggattcaaaggagaaatgaattccyttagattggggaagataatcggaagaggtagaagacaccgtccatgacacttcctggggaagcagatgtatgtataaggatgtgagtattgtggttttgt

SEQ ID NO: 3615 - DNA, 201 bp, Homo sapiens
taaaacacacaacacataccaaaagacagctataaatccaaggcagtgtatgtcaagggtaaattcacctattcagattggatcttgagaagtgcatcagrcttggaaaatgggtaaggaggagagaaaagcaacagtgaatcagaacatgagttcccagttatgggacttgtaatgaattcctcaattaaaacaaaaaat

SEQ ID NO: 3616 - DNA, 201 bp, Homo sapiens
tgactcttaggcttctttcaagctgcagtctgcctaatagagagccttgcatttaatcatcaaaaaggcaaagcaatattaatcagcaagggtgttttggsaaataacagcaaacctgactgtggcgtaagcttgtggtattgtctccagtgtgatcagatctgtattttaattttttaaatgtaaattaataatgatctg

SEQ ID NO: 3617 - DNA, 201 bp, Homo sapiens
aagtctcttctggcactgtctggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaaca

SEQ ID NO: 3618 - DNA, 201 bp, Homo sapiens
ctgttatgtttcctgggtgtctgactcttaggcttctttcaagctgcagtctgcctaatagagagccttgcatttaatcatcaaaaaggcaaagcaatatkaatcagcaagggtgttttggcaaataacagcaaacctgactgtggcgtaagcttgtggtattgtctccagtgtgatcagatctgtattttaattttttaa

SEQ ID NO: 3619 - DNA, 201 bp, Homo sapiens
tctgtgctcgtcccacagcaagccagtcgcggtccaaggctccagaggctgtgcaggaggccgagctgggtggcgatcagcggcgggtccctgtccaaaayccagcagagccgccagggacgccccagacacagaaggcggggcgcggggagggtggggagaccacagcagtgaggcgcgcgagccgggaagtgaacgagg

SEQ ID NO: 3620 - DNA, 201 bp, Homo sapiens
ggtccctgtccaaaacccagcagagccgccagggacgccccagacacagaaggcggggcgcggggagggtggggagaccacagcagtgaggcgcgcgagcygggaagtgaacgaggactgactcctgtcgcttcccgtagccgcccacggacgccagagccgggaaccctgacggcacttagctgctgacaaacaacctgc

SEQ ID NO: 3621 - DNA, 201 bp, Homo sapiens
tttgatgggtgggacagtgtccagtccaccccgacccgccggtcctcaccgcggcagagccggggctgggtggcggggacgctgcctctgcaggcgaggcrctccggggcataagggattatcaggagtcgcggcctttcttggacatccctggctggggtcaggctgtttgccctggggtgtctcctcgctgcaaaccca

SEQ ID NO: 3622 - DNA, 201 bp, Homo sapiens
tcttacttcctgaattgagtcacggagccagagttttgaggttttgactaacgaattaagttaatgacatggggctatatttaggtggtaaaccaagaggkatacagttttttttcttaataaagaaaaagtgatagatttgatcggtgtgtattgttggtgtgcagtataatgacagaattgctggaagtaaaatacagg

SEQ ID NO: 3623 - DNA, 201 bp, Homo sapiens
gcaaggaaagaggacaatatagatgaaaaagaaattgatcctaccagaagtgatccttttatctgcataactctcaggcagttgtggcaaataattggcartatctattgttctgaaactggttttcgcaacttttattgggaacaccatcccctctcctgcatgatcagtttctcctctccacggatcattcacatgagt

SEQ ID NO: 3624 - DNA, 201 bp, Homo sapiens
ctcctgagtagctgggactacaggtgcatgccactacgtctggctaatttttgtatttttagtagggatgggatttcaccatattggtcaggctggtctcyaactcctgaacctcaggtgatccacccgccttggcctcccaaagtgctgggattacaggtgtgagccaccatgcctggcctattttagtatttttaataa

SEQ ID NO: 3625 - DNA, 201 bp, Homo sapiens
gaatattaattatccattgggagacagggcaagaataaaagccagtgaacatatttaaagcacctactatgtaatagagatggtggtgggtgctgattacraaacagctcttgtcctctagtggaggaagaagtcacaatgataatatgacgtgatgaaacagtgttatgaacagggaacgtctgggtagagtggagggaa

SEQ ID NO: 3626 - DNA, 201 bp, Homo sapiens
gggaggagaaagcccacgttaatgacactaaaatatatctttccaaacaaatgtggataaaagccaagtagagaagatgagaactttgaggtccctaacasaaaataaacagtaagcagccagccattccaagtggctgacatgactttgtttaactttatttgtatttctggctggtgtgtttacagccaataggtcaaa

SEQ ID NO: 3627 - DNA, 201 bp, Homo sapiens
gaggttacagtttttgaaaatgggacagcaataagaatcctgggagcaggggtgggataagtggtccatttaaatcaagtcctaactcagtatgtggaagytgtgtatgttttttgtttacttggagattgtaatttgcccctttttataacgtgggcaatcagtataaatggcaaagccagtagagtgtcaaattatgca

SEQ ID NO: 3628 - DNA, 201 bp, Homo sapiens
gcagtctagatgaggtctaatgttcataagctaggggattttcagatatggaaagggataccaattttcaacagccacatagagtatcacattttcactcyatgtttcctgggtgtctgttatgtttcctgggtgtctgactcttaggcttctttcaagctgcagtctgcctaatagagagccttgcatttaatcatcaaa

SEQ ID NO: 3629 - DNA, 201 bp, Homo sapiens
ttgtcacctgctcttaccttgttgcagtctagatgaggtctaatgttcataagctaggggattttcagatatggaaagggataccaattttcaacagccamatagagtatcacattttcactctatgtttcctgggtgtctgttatgtttcctgggtgtctgactcttaggcttctttcaagctgcagtctgcctaataga

SEQ ID NO: 3630 - DNA, 201 bp, Homo sapiens
ggttatcattctacagcattttaaactgacacattgtctggaccatgtgggttcttgaggactcatcaaaactcgttactaaaagcatgaatatcaggcgraatagatagcaatgtgacattcatatttatccctaagttccagtctaatgcagtgccctggtatgtggagtgtagacagatgtgggctaatcatggaagg

SEQ ID NO: 3631 - DNA, 201 bp, Homo sapiens
ggcagttttgtcacctgctcttaccttgttgcagtctagatgaggtctaatgttcataagctaggggattttcagatatggaaagggataccaattttcarcagccacatagagtatcacattttcactctatgtttcctgggtgtctgttatgtttcctgggtgtctgactcttaggcttctttcaagctgcagtctgcc

SEQ ID NO: 3632 - DNA, 201 bp, Homo sapiens
ctctgccctctgatttttcactctcttttcttttttggttttactagtgaaattttgtctttaatgtctctttcttttatgtctttaccgatcactcataratttttttttccatatgtatccagttccaacctttcacctaatgtgaacccccaactctcagttgctcagccagcccttcaagactaggagttcaaaacc

SEQ ID NO: 3633 - DNA, 201 bp, Homo sapiens
attcaaacagtatttaagagtttcagtgaaacatgcattttccttctaccctggtacttagttttactccccaagggcaatcactttttactggtttttaraaatatatccttcctgagatacttatgaatatccaaaagtgtgtgtgttgtgtatatcaccttttatatatcctgtctctttacgtgcatgcattttacc

SEQ ID NO: 3634 - DNA, 201 bp, Homo sapiens
tatttagaacttcctcatttattttaacagctgcataattagcagtaaaacttatgtaagcagtcccttgtgaagggctgtgtctttttgcgattatatcyggtgctatagtgtacatccttgtgtgtgcatcttggtgtgcctgtgctacgtatttctgtaggataaatctgtaaaagtggaatcactaggtcagagggt

SEQ ID NO: 3635 - DNA, 201 bp, Homo sapiens
gctatagtgtacatccttgtgtgtgcatcttggtgtgcctgtgctacgtatttctgtaggataaatctgtaaaagtggaatcactaggtcagagggtatgrtccattttctttacttatttattttatttatttattcatttatttttgagacagagtcttgctctgtcgcccaggctggagtgcagtggcatgatcttgg

SEQ ID NO: 3636 - DNA, 201 bp, Homo sapiens
ccattccttactgtagaactgtttccctacagcctagtaatagaggaggagacatttctaaaatcgcacccagaactgtctacaccaagagcaaagattcractgtcaatcacactttgacttgcaccaaaataccacctatgaactatgtgtcaaaggtttgaagagcaccaaattttcttaactctatataaaaattaa

SEQ ID NO: 3637 - DNA, 201 bp, Homo sapiens
ccgatctcggctcattgcaacctccgcctcctgggttcaagtgattctcctgcctcagcctcctgagtagctgggattacagtcatgtgccaccatgcccrgctaattttgtatttttagtagagacggggtttctccacgttggtcaggctggtcttcaactcccaacctcaagtgatctgcccaccttcgcctcccaaa

SEQ ID NO: 3638 - DNA, 201 bp, Homo sapiens
actctcagccaaatacaaaatactatgaatagtatttaccttgtgtctctttccaaagaactcatagtggtttgcagctattgcagatatcctggccatgmggtatgcagttcctttttttttttttgagacggagccttgctctgtcgcccaggctggagcatagtggcgcgatctcggctcactgcaagctccgcctcc

SEQ ID NO: 3639 - DNA, 201 bp, Homo sapiens
tgtcctccgttttcacagaagccacatagtcgtgggttaaatgagtcagcggcagggcactgtgtctcatagttaaaaaaaaaaaaaagtattactgaagyaatgcaggatcttttctgaagtagaaggcatgatgaacccagaaaactaaagcagcaagtggccaccgttcttagcatagttgtttctcaaactggaaca

SEQ ID NO: 3640 - DNA, 201 bp, Homo sapiens; identical to SEQ ID NO: 774

SEQ ID NO: 3641 - DNA, 201 bp, Homo sapiens
taggtccttccccattctctacacacaaaatcagatactctgatgtgcagctgtagccccagtctacactgtctgttgtattttttgttttctggtgtcaygtgcctcccaccctgctcctagcaattgccatgacaacaaatagataattggcttccgtaatttctcatcttattgcctaaggcaacagagagcttgtgg

SEQ ID NO: 3642 - DNA, 201 bp, Homo sapiens
tcattccattccttactgtagaactgtttccctacagcctagtaatagaggaggagacatttctaaaatcgcacccagaactgtctacaccaagagcaaakattcgactgtcaatcacactttgacttgcaccaaaataccacctatgaactatgtgtcaaaggtttgaagagcaccaaattttcttaactctatataaaa

SEQ ID NO: 3643 - DNA, 201 bp, Homo sapiens
tattgtatttttagtagaaacagggtttcaccatattggccaggctggtctcaaactcctgacctcaagtgatccacctgcctcggcttcccaaagtgctsggattacaggagtgagccaacgtgcctggtcaaaatttttgttttcgtaattttaagtatgtgtgtagtaagtctcaatggaaatgtaattcttatggca

SEQ ID NO: 3644 - DNA, 201 bp, Homo sapiens
aaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatctaaaaaaaaaaaaaaaaaatcaaaattaaaatctgagtcagtccgcctg

SEQ ID NO: 3645 - DNA, 201 bp, Homo sapiens
agtacaggtaactaattgactccctctgctgccaacttggttttccttctgagctatagcatcaggctgtgtgttttgtgttttcttgagattttgttaartatatctggggtcccttctacctggttggaactgggattcccaccattcttgtggggatagaatctcaggttacacctatttccccaatcctctgtagcc

SEQ ID NO: 3646 - DNA, 201 bp, Homo sapiens
gtggagaccctaaaactgcttgcttgcactggccatcatctcccatcagggtagacggtttcaggtggcagtcctttctcctaaggagttagtcttgtttrtatgtattcaaggaaaaatacatcagtcccttggaactaaaaggcatgcagtcctgagtccccagataggtgaatattgtaacacatacctttcccgaaa

SEQ ID NO: 3647 - DNA, 201 bp, Homo sapiens
cagaccccaggcacagggggccttcctggcgtgtttcactcatacagagggcatcgggtcccaccctgtcactcatttcatcgtctaaaatgtaatcatgwgtgtttgcttcgagccagggacagtgctgctgcaggggacccagctgggaccaaggcagactgtctctcccctcctgggatttacagggtcatggctctg

SEQ ID NO: 3648 - DNA, 201 bp, Homo sapiens
gggcggaaaggaccacagtgtcaagtgtatttttggatcatagttttcaagcatatttttagtaccatttataatttttttatatgtcaatataaaatatwtagaaaatattttctactggatgttacaaattaatctttattatcttttctcaggacttacaaagtacccaagcatctagtctggaactgacagagataa

SEQ ID NO: 3649 - DNA, 201 bp, Homo sapiens
ctctcaacagccatgctcccaccttcttgctgacattacatcttattctctgtaatgtttgccaatctgatggggggcggaaaggaccacagtgtcaagtrtatttttggatcatagttttcaagcatatttttagtaccatttataatttttttatatgtcaatataaaatatttagaaaatattttctactggatgtta

SEQ ID NO: 3650 - DNA, 201 bp, Homo sapiens
ccagaactgtctacaccaagagcaaagattcgactgtcaatcacactttgacttgcaccaaaataccacctatgaactatgtgtcaaaggtttgaagagcmccaaattttcttaactctatataaaaattaagttgtaatgagctgttacgagtaacctgtatccacaatagaggcccaaagcagccccctctgcatttgt

SEQ ID NO: 3651 - DNA, 201 bp, Homo sapiens
cctttccactgctcctatcaaaagaatggaaaccctcaacttgctgctttgcagattcaggttttgtgcttcattctggcctctcggggtggggccgggtkagcagcaaggctgagctgcccctctttcttctgaagccttcatgggggcgaggagcacagggagagctcagtgcagggcctcccagtggccttctcagag

SEQ ID NO: 3652 - DNA, 201 bp, Homo sapiens
ttccttgacagtcctttccactgctcctatcaaaagaatggaaaccctcaacttgctgctttgcagattcaggttttgtgcttcattctggcctctcgggktggggccgggttagcagcaaggctgagctgcccctctttcttctgaagccttcatgggggcgaggagcacagggagagctcagtgcagggcctcccagtg

SEQ ID NO: 3653 - DNA, 201 bp, Homo sapiens
tgttgaccagaagccttaccaataacacaaagtcaattaacacatgtgttatatgttatatgtatgatatactgtattcttacaatctaagaagctacagaagaaaattctattaagaaaattataggaaaatgtgtttactgttcattaagtggaagtagatcatcataaagatcttcatccttgtcttcatgttgagag

SEQ ID NO: 3654 - DNA, 201 bp, Homo sapiens
aatacacttccacctctctaataaaagtgacaacttgtcttgggcattagaaacttggaggcaactccagggctctccctggaaaatcaagatcttgaatmtgagaagtgctgacaaagccctcacaggatccccagcccaggggtaaaggaacaagatgtttaaaaatttgagccacttccattcagctttcactttctg

SEQ ID NO: 3655 - DNA, 201 bp, Homo sapiens
gaatgagagagcaaattcaatcgggcaaaaacaatgatattccgtaaacaataatgacataagcctaggaaatgttttaagaataaagctttggccgggcrcggtggctcacgcctgtaatcccagcactttgggaggccgaggcaggtggatccgaggtcaggagaccgagaccatcctggctaacatggtggaaccccg

SEQ ID NO: 3656 - DNA, 201 bp, Homo sapiens
tttttttaaaaaggctgacaacagtaaaaataagttagtgggagccgggcacggtggctcacgcctgtaatcccagcactttgggaggccgagatgggcgrgtcatgaggtcaggagatccagaccatcctggcttacacggtgaaaccccatctctactaaaaatacaaaaaaaattagccaggtgttgtggcgggcgcc

SEQ ID NO: 3657 - DNA, 201 bp, Homo sapiens
ggaaaatggtgtgaacccgggaggcggagcttgtagtgaaccgagatcacaccactgcactccagcctgggcgacagagcaagactccatctcaaaaaaataaaaaataaaaaaaataataagttagtgggatctggatataaagttttttattttatataaaggcaggttcaaacactattacaattgctacatttgtag

SEQ ID NO: 3658 - DNA, 201 bp, Homo sapiens
ttttgagatggaatcttactctgtttacccaggctggagtgcagtggtgtcatcttggttcactgcaacttccaccttccaggatcaagagattctcctgyctcagcctcctgagtagctgggattacgggcatatgccaccacgcctggctaattttcgtatttttagtagagatgcggtttcaccatgttggccaggct

SEQ ID NO: 3659 - DNA, 201 bp, Homo sapiens
tctttgcagttatggaacagtttgtatcttgcttggcgtggaggttgcccatatctgcacatgtgataaaatggcataagtagtatatacacacacggtaccaggccagctcctaatcttatgctatcattacgtgggatggaaccgttgggagaaatagggtgaagagcacccaggacatctctgtactgtcttatcaac

SEQ ID NO: 3660 - DNA, 201 bp, Homo sapiens
gatggcaagtgctcccgtggccagggagagatggataaagctggagagacagataaacaaaacagtcaagtctgttggcaggaagcgaagagggcctgagctctggtggagactggtccctggagcttccacagtttaaccggaagggagtagggcaagacagttgctgatggggataggtgtggagctttggtgatgggc

SEQ ID NO: 3661 - DNA, 201 bp, Homo sapiens
aaaataaagcaaggttgggctgggcatggtggctcacgcctgtaatcccagcactttggaaagccgaggcgggtggatcacctgaggtcaggagttcgagrtcagcctggccaacatggtgaaaccttgtctctactaaaaatacaaaaattagctgggcatggttgcgggcgcctataatcctggctactcgggaggctg

SEQ ID NO: 3662 - DNA, 201 bp, Homo sapiens; identical to SEQ ID NO: 872

SEQ ID NO: 3663 - DNA, 201 bp, Homo sapiens
attaaataaaggaaaaagcaatgggtgaaattaattttaataatacattttatttaatccaatctgttcaaatatcatttcaacaaaaaatcgacatttgaaaaattcagatatcttaagtaattttatacaaaagtcttcaaactccaggatgtattattttacacgtccagcacatctcaactctaactcaccaccttt

SEQ ID NO: 3664 - DNA, 201 bp, Homo sapiens
ctcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttca

SEQ ID NO: 3665 - DNA, 201 bp, Homo sapiens
tcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttcat

SEQ ID NO: 3666 - DNA, 201 bp, Homo sapiens
gtgcctgcttctattacaacactctctactcgcagactctgtcagctggagtttggaaatctttatatctgatttttctgtattttaatggtgatgtttctttttttttttttttttgagacacagtctcgctctgtctcccaggctggagtacagtggcacgatctcagctcactgcaacctccgcctcccaagttgaag

SEQ ID NO: 3667 - DNA, 201 bp, Homo sapiens
ggcacatgcgggcttccgtagagtattctctataaaactgttagctcactgcggactgagcactgctgcttccgcttgctgtattgatactaccaaatacygtattttctttgaaaagtgtcacacgcccgcgggaggaagtggggtgtggtgtcacagcagcataggaggacaggagtgtttttgctactggtgtaccca

SEQ ID NO: 3668 - DNA, 201 bp, Homo sapiens
atggtaattgtgcttgggtggagatggcagagctcagaaacagaaggaatggcgtgaacagagccatagagacagatattcagggaaccttcagcaaatcragagaagtccaggcaggctgggactccgctgagagtcgtgctgtgtgaaggaggcaacttgaacccaataaacggaggctttttaataacaggttaagaa

SEQ ID NO: 3669 - DNA, 201 bp, Homo sapiens
attagaaacttctgcagagattataaacctttagaaaataaagcattttatcctgcacaagaatattgacattcttaccaggaatccaactatccaagtgytttgttgttcctgcaataagtttgatttaaactctggaaaactgttttttaaaaaaattccatgtcgatcactagcatccctctcccactcccctctccc

SEQ ID NO: 3670 - DNA, 201 bp, Homo sapiens
agaaagctttggggaaaaatctatacatatttatgaggggagttaagtgcaggtgccaggggtaaacatatgtccaacatacatcccatgttcactttggrgcacagttgtagcattaaaattagatcctaaatttggctctttacatcaaaaggcaaatgataggacacaatgacatttagtgtgcagcacctgtaagct

SEQ ID NO: 3671 - DNA, 201 bp, Homo sapiens
ataaaaatctttgctcgtatcactaaagtaatctttagagacaaatatatgccaagattttttttaaaaggtgctcaggcccatgcttagatatgtccagrtaatttagttgggcagtatctactcagcacttgtgtgttggcttgggaaaagggttcctggggccgggtgtggtggctcatgcctgtaatcccagcactt

SEQ ID NO: 3672 - DNA, 201 bp, Homo sapiens
gcttcgatttatattaagtgctacaaagatagtgaacaaggtgcaaggtggagagtaagcatgtggcctactgagactctgtggtccgggaatctccccarcggagggaacattgaaactgacagctgaagagtgacagagctggttaggtgaagagcaggaggaaggaagctccttacaggctggaagaccctgctgagg

SEQ ID NO: 3673 - DNA, 201 bp, Homo sapiens
ggaaggaagctccttacaggctggaagaccctgctgagggagagtccaacgtgttccaggaactgaaatgggaccagtgtggtgacagctgcaagggctgygcagactggaagcccacactggggaaggcaccaaggcctgggtcatgcggggtttctttggagcctggaaaaatgattgtattttgtgcaacttgtagta

SEQ ID NO: 3674 - DNA, 201 bp, Homo sapiens
agccccatttgttgcaaaaataaaaggtaatgccctttctcagaaacgtcttctagggaatttgacaaaatgttatgaaacccagaagtcataggtcctcyggaaaagctgaggatagcagcatttcatggcatctgtgacagcagcagtgccagacccgttgccattggcccacctagggcatggatgcatgtcgtgcac

SEQ ID NO: 3675 - DNA, 201 bp, Homo sapiens
atagagaaagttcaggactgactacaaaggaatctaaaatgagatgttaggtagaagataaaggacagagatagacattgagaaactgggctcagagaccrctcctcctacacccagagtctatgaagttacagaaaccagaagaagaagaggtgggttgtgttctgtgcagttgaggtgttgaaattgaggcccacgtgc

SEQ ID NO: 3676 - DNA, 201 bp, Homo sapiens
ctgcaaggcagaacatatactaatttaccgttctgtgcaaaactggaaagaatattgacgctcagagctggagaccatatgctcttctcattacacatttwattttttaaaatatatttttaaattttgcaggtacacatccaagctaagaaagcccattgacatgatcctcttggtacaaataccacatgttcactggaa

SEQ ID NO: 3677 - DNA, 201 bp, Homo sapiens
gataaaggacagagatagacattgagaaactgggctcagagaccgctcctcctacacccagagtctatgaagttacagaaaccagaagaagaagaggtggrttgtgttctgtgcagttgaggtgttgaaattgaggcccacgtgcagatcttcacaggcttaaatcagagaaatgtcaggggcatcttggaggcattagtc

SEQ ID NO: 3678 - DNA, 201 bp, Homo sapiens
ttgtgcacggcactatgctagcttctgtaaggaatagatatgtcaatggtgcccggcctccagagcttacagtgtggtaggaaagaagacaaccttggaaraaagatacaatgtgctaattctccagtggagcgaagatgttgtgtggtacacagatgagagattatccatcaggatgagggggaaggaggccgcttgtca

SEQ ID NO: 3679 - DNA, 201 bp, Homo sapiens
tttgtggcataaaccagaagctaatggctgaagcgctggccatgattgagagcactcaacaggtaggagcatgtgccgtggacacgttcccgccatggcckctcagcaaggatgtccatgcacttctgctgcttcacctgtggcagccctatgggaaatgccgggatgtatttctgagcaccggccttgcccttggctttc

SEQ ID NO: 3680 - DNA, 201 bp, Homo sapiens
cacatgtgcctgtctgtgtgcacgtgtgtgcctgtctatgtgcgtgtttgtgtgtgtattgctgtcttataaatcgtcacatcagccctgttaggagggcmcttggcttactttacaggtgaggaaactgactcaggtttgtcagttgcctaaggtccaattaataacacagggcaaagccggtttcaaatcaggtctatg

SEQ ID NO: 3681 - DNA, 201 bp, Homo sapiens
gtgaggaaactgactcaggtttgtcagttgcctaaggtccaattaataacacagggcaaagccggtttcaaatcaggtctatgcacctcagaagataacgygtcagactccagcaaatttagaaaggcttcttcaagggagagtgccaggacaggttgactttagtcagtcctgatgaaggtgagtagaaaaatgaggtta

SEQ ID NO: 3682 - DNA, 201 bp, Homo sapiens
gggagagtgccaggacaggttgactttagtcagtcctgatgaaggtgagtagaaaaatgaggttagaaaagaaggggctggtgcaccaggaagcaccacgmcctcctgatgcaaaagggtcatccctggagacctcagggctcctgctctgctccctttcagctcttcgtgcgagaacctgagaagaggctgggcgtgagg

SEQ ID NO: 3683 - DNA, 201 bp, Homo sapiens
gttgttctcaacatctgtcccaagctccagtgatgttccaaggacccaacaggccagcctcaagcactctaattacttgtgacagaaccacatctaatacrtgggttagtcatttgtgataaaataaaaattttaccttgtttttagctatcagaactattaaaccatgtctcaccttccactgcagattaaaattgactt

SEQ ID NO: 3684 - DNA, 201 bp, Homo sapiens
ttatatctgatttttctgtattttaatggtgatgtttctttttttttttttttttgagacacagtctcgctctgtctcccaggctggagtacagtggcacratctcagctcactgcaacctccgcctcccaagttgaagtgattcttctgcctcagcctcctgagtagctgggattacagatgtgcaccaccacacctggc

SEQ ID NO: 3685 - DNA, 201 bp, Homo sapiens
atctcagctcactgtaacctctgccctgtgggttcaagggattctcctgcctcagcttcccgagtacctgggactacttgcgcacacaaccgcacccagckaattctttgtattttagtagagatggggcttcaccatgtcgcccaggctggcctcaaatgcctgagctcaggcaatccgcccacctcggcctcccgaagt

SEQ ID NO: 3686 - DNA, 201 bp, Homo sapiens
ttctttttgtttgtttgttttgtttgtttgttttgagacggagtctcactctgtcgcccaggctggagtgcaatggtgtgatctcagctcactgcaacctycgcctcccgggttcaagtgattctcctgcctcagcctcctgagtagctgggattacaggtgtgcaccaccacactcagctaatttttgtatttttagtag

SEQ ID NO: 3687 - DNA, 201 bp, Homo sapiens
gttttgtttgtttgttttgagacggagtctcactctgtcgcccaggctggagtgcaatggtgtgatctcagctcactgcaacctccgcctcccgggttcawgtgattctcctgcctcagcctcctgagtagctgggattacaggtgtgcaccaccacactcagctaatttttgtatttttagtagagacagggtttcacca

SEQ ID NO: 3688 - DNA, 201 bp, Homo sapiens
tatttttattatatctttctgtgtatgttactataaacacactttagactgggcttctgggcacttaggcagttgtgcttctcttggtgccttttccccatttttttttttttttttgatttgcatgtatgacagttttcatgtcttacggggaaggctattgggaatcccactttgtagaagataggtatgctcctttct

SEQ ID NO: 3689 - DNA, 201 bp, Homo sapiens
aaaaacagcacagaggggtttctttctccttccagtaggcttcccagcaaatcaaggatgactgcctgtagcacgccgctcctcacctagtctcaaaatastccagaaagttctccctacaccttattctatccagcacctgaaatgctgccagctaggatcttaggggacacagatcctcttaaaaatgcaagcactgct

SEQ ID NO: 3690 - DNA, 201 bp, Homo sapiens
tttctgtccctcttatgagagatctccttaacccatttatgcctgaggttgcaactttttgaattttgaaatcagaccttggtgatgaccttgagcagtargatataaataactcccacatgcttagcgttccaataatggaacactaggcataaatgagttccgtgcagctgggatgctttaccaagacctgagccacaa

SEQ ID NO: 3691 - DNA, 201 bp, Homo sapiens
atcaaggatgactgcctgtagcacgccgctcctcacctagtctcaaaatagtccagaaagttctccctacaccttattctatccagcacctgaaatgctgycagctaggatcttaggggacacagatcctcttaaaaatgcaagcactgctgagattcccttcacccattagggtggcttaggcagtaacaaagagaaaat

SEQ ID NO: 3692 - DNA, 201 bp, Homo sapiens
ggctgaagcgggtggatcaccttggggtcaggagtttgagaccagcctggccaacatggcgaaactctgtctccactaaaaatacaaaaattagccaggcrgggtggtgggcacctataatcccagctactcaggaggctgaggcaggataatcacttgaacccatggggcggaggttgcagtgagctgagaccacaccac

SEQ ID NO: 3693 - DNA, 201 bp, Homo sapiens
tttttattgtagtgaaaataaacaacataaaatttacaattttaaccactttaagtgtaaagtgcagtggcattaattagattcatgactgtttccagaaygttttcatgacccaagcagaagctctgtacccagtaagcagtaactctccatttccctctcctttcagtcccaggccacccccttctactctttgtctct

SEQ ID NO: 3694 - DNA, 201 bp, Homo sapiens
ttttttgtatatttagtagagatggggtttcaccgtgttagccaggatagtctcaatctcctgaccttgtgatacacccacctcggcctcccagagtgctrggattacgggcgtgagccaccgcgcccggcccctacacgcccactttttaagctcacagatctgttctcatcttgatgtgactctgtaatattcttccag

SEQ ID NO: 3695 - DNA, 201 bp, Homo sapiens
agagtgcctcaggaaagtgcatgccttctgtgaatctactatccctcttttgttttttgttgttgttgttgtcattgttgtgtttgtttgtttgttttgaraaggagtctcactctgtcgcccagattggagtacagtggaacgatctcggctcactgcaacctccatctcctgggttcaagtgatcctcctacctcagcc

SEQ ID NO: 3696 - DNA, 201 bp, Homo sapiens
agttggaagtgtgaggtcagcctgggcaatgtatcgagacccctgtctccaaaacaataaagggaaaaaaaaaagaaacaaaatgggcatttaggctgggygcagtagctcacacctgtaatcccagcactttgggaggccaaggtgagcggatcacctgaggtcaggagtttgagaccagcctgaccaacatggagaaac

SEQ ID NO: 3697 - DNA, 201 bp, Homo sapiens
ccaggcttctcagcagtccgtgacttaggggaaaatgtaacaagtgtttgttcatctaccctgcatgtactggaagagataaaagttggaaaatagatcaraacgcacgtacactattatttttctcttcaaggctggcagaaaaagcagccttggagtgggctcatcagtgagcaagcccctgagctgggaggtggaggt

SEQ ID NO: 3698 - DNA, 201 bp, Homo sapiens
aaaaattaaaagtgaactaaagtctaccttcctctgtgtctcctttgaattctgaaaggccgatctgtattctgacatttaagtagtgttactatttcacrcctaagtagctctagatcctataggaacagctctgtctctgggtcgttccctcaggttggatttgagggcaggccgccgtggttttgcaggcctctgaag

SEQ ID NO: 3699 - DNA, 201 bp, Homo sapiens
agacttcaagatacctaaacacaaatccaactcacaacttatttaattggaaaattgttcattccatgtcctaaaccttagacccaagcaagaggggttcygcccagcccctcacttagaatcctccctttggcctttctcaaaccacactccttcctgtgaagccaagaggtcgtctctgttcctaaactactccccagg

SEQ ID NO: 3700 - DNA, 201 bp, Homo sapiens
tggtttactagccttcggagaaaaaagatacctcgaaaaaaatgactataattattcttttccttcttttcccatcttgtttttctggagagggagtctayaaatctgatcttatttgcatgatatttgccaagttctcagtgcatttacaaaattaactgttattagtctgataaaaatcatgagtttatttctttaatg

SEQ ID NO: 3701 - DNA, 201 bp, Homo sapiens
agacctgagaataggtgggaaggtgtgtggaatgcatgggagtggggctgaactgttgcctccagtcccctcccaccactttctccacatctaaattgacwgtgttaaattctgaaatgtcagcctttctaggaatttgtaagcatccaaacacttagaagaaaccgttcactcaagcactgttggaaatggtttcgctct

SEQ ID NO: 3702 - DNA, 201 bp, Homo sapiens
catctttaacttaattacatttggaaaaaaagaccctttttccaaataaggtcacatctacaaggttctgggggttctgacatgaacatacctggacatawcttctgggggccaccattccacccatacagctgatatcacagaccatgtgtgctctggatgtgcaggtctttgtcaagcatggcagtgggtactaaacat

SEQ ID NO: 3703 - DNA, 201 bp, Homo sapiens
gtagaatggattgatgatgaatggatgaacagatgaaaagacacaagctgtacattcaaaaaatgtccaagtgaatgttattccaattaaaagtgcaagarctgaaaggaaaaaatatatcaccagacttaagtaggggagatggcaaacaaaaattcttctgtgaaggtagactttttagagtggaagaggctttgcaga

SEQ ID NO: 3704 - DNA, 201 bp, Homo sapiens
cagctacctgggaggctgaggcaggagtagagtaagacaaagggtgaggaagtcagatgacattaaggcaattgtaagaaaagcaagtctgcataatattyggagtcactagcctacctcatcacatggctggaaataactttagatattatatttaaaatagaataattaatataagcagactgttgacagtctgcaggt

SEQ ID NO: 3705 - DNA, 201 bp, Homo sapiens
tcttagagtattagaactaagaagaaccttaagattatattttattgacaataaaactgggcccaacccatgtgtttgaagccactttcaatgctttcacrtgattctcattggacgttacaggaccccatgagacaagcaaggcaagtgtcatggtccctgttccttggatgagtcttggaggctgccagaggggaaatg

SEQ ID NO: 3706 - DNA, 201 bp, Homo sapiens
ttggaggtcatgtctttccttttcacaacaggaagggctggcaccttctgctctttcggtcctgacaactgtctgctcagagcatcagccaaacaaggccytgtcatcccagccaggaaggatgcgcggtgcatgggagtggcaggacatttgtggaaggagtacagccgaccccccagtttcctccagtccttgtcccca

SEQ ID NO: 3707 - DNA, 201 bp, Homo sapiens
cgcagggaaaggacgtgatggcagtggggattccctcttgctttgagcccttctgaatgcaagcagaaaaagaaacccttttatattactttttaattgamtataataacagaaacaatgaaaagaatgtgaccttgactttgcaactctatttcccaggcatattcctaacaacacctaagaaagctaggatgtaggtag

SEQ ID NO: 3708 - DNA, 201 bp, Homo sapiens
tagttgaaaatgaggactgagatacttgtacactaaactccgtggcagcattattcaccatggccaaaaactagaaacagcccaaatgttcatcagcagargaacaaacaaacaaaatggggcatattcatacaatggaatatcactcatccttaaaaaggcatgaaactttctgacacctgctacgacacagatgaacct

SEQ ID NO: 3709 - DNA, 201 bp, Homo sapiens
aaagcgagaaataaaaaaaagaatcaccaacttccctgcaagcattcaacaaatgcccatagtataaaaccaacaagaggagtcaaaccgcctcttctgcwtccccaccagccacactccgacacccccactgcgccccatctttctgtccctgatgcttgtcaaattgttccatcgtcagccccaccagagctcatgcta

SEQ ID NO: 3710 - DNA, 201 bp, Homo sapiens
aaggaaggatgaagagacagagggcatttttagggcagtgaaacttctgtgtgatccactgtaatggtggatccatctcattatccatagaatgtacagcktcaggagtgaacccaggccaggcacagtggctcgtgcctgtaatcctagcactttgggaggctgaggcgggtggatcacctgaggtcaggagttcaagac

SEQ ID NO: 3711 - DNA, 201 bp, Homo sapiens
gagtgaacccaggccaggcacagtggctcgtgcctgtaatcctagcactttgggaggctgaggcgggtggatcacctgaggtcaggagttcaagactagcytggccaacgtggtgaaaccccgtctccactaaaatacaaaaattagccaggcatgatggtgggtgcctgtaatcccagctactcgggaggctgagacagg

SEQ ID NO: 3712 - DNA, 201 bp, Homo sapiens
cgtttctgttcctagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacggga

SEQ ID NO: 3713 - DNA, 201 bp, Homo sapiens
gtcagtgtgtggttttgggtgagtccagcagtgtcctctgcagaaggggaagtgaaaacatttgttcacatggatagtggacctatgtgaggttctggctrtccatgataaagcactggttaagtagacatggggcaccaaaaataatatcttttatagcccccaaacagcgtttgtcttttgtctttttccagggcgcaa

SEQ ID NO: 3714 - DNA, 201 bp, Homo sapiens
ccaggcatgatggtgggtgcctgtaatcccagctactcgggaggctgagacaggagaatcgcttgaactcgggagatggtggttgcagtgagccgagatcrtgccactgcactccagcctgggcagctgagcaagactccatctcaaaaaaatagaagagtgaacctgaggttcacttatggactttgggtgataataaca

SEQ ID NO: 3715 - DNA, 201 bp, Homo sapiens; identical to SEQ ID NO: 866

SEQ ID NO: 3716 - DNA, 201 bp, Homo sapiens
agccaggaggcacctcacagagactggaagcacagagggaggtgggccagctggggcccgaggatccagacttggtgagactcacagaccttggcccactrccctcctccctcctccctcctcacccacttttctcccttcttcacatcagtactggtggcagcaccctgagctgaaggagaaaagttcatattcaacatc

SEQ ID NO: 3717 - DNA, 201 bp, Homo sapiens
tctataatctctgtatttataacacatgccttaaaataccaattgcatatatttcttttcttttggtttttgaattatcatacagtaaaattgacttttgscttggtgtagttctgtgaatttaagtctagacttctgtgaccactagaacaatcaagccggagaacagttctgtctttccccaaaatttgctcatgctgc

SEQ ID NO: 3718 - DNA, 201 bp, Homo sapiens
gcaaagtttgtgcaataaagtatctttgtggtattggattttcgagagccaccgttatcaatgggagagtgactgttgaatgctacaggcgtgtgcactcycccgtgggcatgaagagaggtccacgggctggctggattgggagactccggtcatttctgcaaggagagcgccacaggactgccttgttccctgggctgt

SEQ ID NO: 3719 - DNA, 201 bp, Homo sapiens
cagaattgtgaatctgtttctgtttagtgttctcttccagaggattgcattattcactgaatgtctgttgtctgaaatagaagttcccacagtagtttgtrtacgcatcatttaggaagataagtggtttttcctgttatgtatacaaataaccagtctgtgttaatgtctattatgggtgacatgaacagatccttctcg

SEQ ID NO: 3720 - DNA, 201 bp, Homo sapiens
attgaaagaaatgtctgatattgggatcattttcctaacacaatttccattttcattttctgtaaagcccccacaagagttgacagagttcctgaggtggsgatgagtgagccgtgcctctttctacagtggatgtagtggatgtggcttacagatgccttttacatttccagctgtagacagaaaatgccagaggccaca

SEQ ID NO: 3721 - DNA, 201 bp, Homo sapiens
gaatgaatgagtgaatggatgcatagtcactaaatcagaaatcgtggatactgtaatcatagaacattaggtcataaataccaaggatcctgaggaagaaraagaaagaatatctatgatttggacagccatttttccaattgtggaacattgtttagcatttcaaataatgaaaataaacacatatagaaggcttactat

SEQ ID NO: 3722 - DNA, 201 bp, Homo sapiens
ctgatcgtagaaatctatgtttcattcagtttggcacagatacaggttttgatgctataaaccattttcatttgaagtgaaaccaaagctcatcaaagcaygagtgatggggacttaagaggacggactcaactcaattactgaattcccctttgtaacaattctgaaatatgcccaaatgcactctgctcagaccaccct

SEQ ID NO: 3723 - DNA, 201 bp, Homo sapiens
ccgctccccccaccccacaacagtccccagagtgtgatgttccccttcctgtgtccatgtgttctcattgttcaattcccatctatgagtgagaacatgcrgtgtttggttttttgtccttgcgatagtttactgagaatgatgatttccagtttcatccatgtccctacaaaggacatgaactcatcatttttttatggc

SEQ ID NO: 3724 - DNA, 201 bp, Homo sapiens
gatgatggatgcaggcttgcagtaactatggaagccatcacagttcacttacacaaaagtgtttacggagagaccactgcaagagtgctgggaccagagcrtagagggaaaaaaagtcaaacaagtaagctgaaggaactcaggaagactgccttccctttagagcatctattcttgcagaagaaagtggcaataaacaaa

SEQ ID NO: 3725 - DNA, 201 bp, Homo sapiens
ttccagtttcatccatgtccctacaaaggacatgaactcatcatttttttatggctgcatagtattccatggtgtatatgtgccacattttcttaatccartctatcatttttggacatttgggttggttccaagtctttgctattgtgaatagtgccacaacaaacagatgtgtgcatgtgtctttatagcagcatgatt

SEQ ID NO: 3726 - DNA, 201 bp, Homo sapiens
ctctgtttatatgctggattacatttattgatttgcatatattgaaccagccttgcatcccagggatgaagcccatttgatcatggtggataagctttttratgtgctgctggattcggtttgccagtattttattgaggatttttgcatcaatgttcatcaaggatattggtctaaaattctcttttttggttgtgtctc

SEQ ID NO: 3727 - DNA, 201 bp, Homo sapiens
gcagtatccctaaatctgggaaaggttgtaaaaaaaaaaaaaaaaaaaaaaaaaaaaaaaaaagatgctatcttaaagatgcatttttttctggcatgtaraagttggaaacagactaaatatgtagctacagactttagtaacgcagatcgtagagctactgtcaataggatgtcatgcaagaatgacaaggaagcctga

SEQ ID NO: 3728 - DNA, 201 bp, Homo sapiens
tggttttgaaacttgaagaggatatatcgctcagcccagtcaaagaggagcgaaggattgagccagcaatccaacattgttttcaccctctaacaatatgycctatgatgaatctgtgttgtagaatttgaggaaagatgcttagtgtggtacccaccataatgagtacctggaatgttacagcaggtactcagagctggt

SEQ ID NO: 3729 - DNA, 201 bp, Homo sapiens
ataacagaggcataattttatgttgagaagcaaatatttcttttagagtaaacgttgaggtataatcggaagacaaattacattttacctaatggaggggkgaaactgggctagcacatgggcagtgtatcattatgaattttaaatttttaaaaatttatatgtatttaggaggtacaagtgcagatttcttttttcaat

SEQ ID NO: 3730 - DNA, 201 bp, Homo sapiens
ctatgtatggcttcgatttatattaagtgctacaaagatagtgaacaaggtgcaaggtggagagtaagcatgtggcctactgagactctgtggtccgggartctccccaacggagggaacattgaaactgacagctgaagagtgacagagctggttaggtgaagagcaggaggaaggaagctccttacaggctggaagacc

SEQ ID NO: 3731 - DNA, 201 bp, Homo sapiens
accctgctgagggagagtccaacgtgttccaggaactgaaatgggaccagtgtggtgacagctgcaagggctgcgcagactggaagcccacactggggaakgcaccaaggcctgggtcatgcggggtttctttggagcctggaaaaatgattgtattttgtgcaacttgtagtagaaagcccactttgggatgctgtagta

SEQ ID NO: 3732 - DNA, 201 bp, Homo sapiens
tgtaggcattgcctccatttagtgtctctgcaaacaccaactttgccatacgcagatcacggcctagataacaaaagtgaagatcatgaacttaatggctratttttcttctctttctttcttcccttaaactctgactaagaaatcaccatttgactgcagcaatttcgacaaagaattcttaaacgagaagccccggct

SEQ ID NO: 3733 - DNA, 201 bp, Homo sapiens
aacctgtaagttgatattatgaagaaggtgaaccatgaaggagatgatggacagagaacagtggctgggaaatgagaccccaaggatggcaagtgctcccrtggccagggagagatggataaagctggagagacagataaacaaaacagtcaagtctgttggcaggaagcgaagagggcctgagctctggtggagactggt

SEQ ID NO: 3734 - DNA, 201 bp, Homo sapiens
aaggggctggtgcaccaggaagcaccacgccctcctgatgcaaaagggtcatccctggagacctcagggctcctgctctgctccctttcagctcttcgtgmgagaacctgagaagaggctgggcgtgaggggagacatccgccagcaccctttgtttcgggagatcaactgggaggaacttgaacggaaggagattgaccc

SEQ ID NO: 3735 - DNA, 201 bp, Homo sapiens
ataaatgtctgtgatattatcttctcccaggatattttgatttcttgttcactcaaggggacatcatctttgggattcttttgttcctctacccctggagyagtattgtccgatagaaataaatagaatgagggctacatgtgtaattttacatttccaagtagcccacattaaataaaggaaaaagcaatgggtgaaatt

SEQ ID NO: 3736 - DNA, 201 bp, Homo sapiens
tcactcctcagcctcattcctgttaatttcctgtctgccttttggttgtgcagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacc

SEQ ID NO: 3737 - DNA, 201 bp, Homo sapiens
gtgaaaaacaggtcatgggccaggcaagatcaaggaggggcagcagagggcacttctgggcgagcagtacagtggcatcgcagaaggacaggtgggagggraagggataggctgcatcagctgcctttgaaaacgccatcgagcaatagtattgcagccatttataccataatatttcctacagaggacctcgtttagttt

SEQ ID NO: 3738 - DNA, 201 bp, Homo sapiens
taccaggaatccaactatccaagtgttttgttgttcctgcaataagtttgatttaaactctggaaaactgttttttaaaaaaattccatgtcgatcactarcatccctctcccactcccctctccctaccccgataagccttcacatttattttgagacagaaaagagaatggctgggctctgattctgactgccaagctt

SEQ ID NO: 3739 - DNA, 201 bp, Homo sapiens
tgcagttcagatctttaaaaatctgctagatttcatttcctgtctctctcacgctgtaaattgtagaaattgatgccactgtgtttgtgagccatgcaaasaattgaaaatcatttttttcctaaaatttggttaaaatccctagatgtccttgatgtggcattattaacagtgcttgtgtattttgcatatatggtcttt

SEQ ID NO: 3740 - DNA, 201 bp, Homo sapiens
ttttctataccattcctttaagtcatagaatcagatgagcttaggggctagaaggaagagggagcgatgggaaggcagtcgttggtcatgccctgggcctrgatcgcgggaatcagtcattcagaaagccccatatgttgggtgggtctcacagcttacagagaagccagctgaggtgtgcaggttaagaaacttgatcta

SEQ ID NO: 3741 - DNA, 201 bp, Homo sapiens
agatatctgtttgaggtcctgctttcaattctttggggtatgtacccagcagtagaattgtggggtcgtagggtaattctatgtttaattttttgaggaamtgccatattgttttccacagtggctggaccgttttacattcccaccagtggtagaaagggtcccaattattccacattctcagcaacgctgtcttttgtt

SEQ ID NO: 3742 - DNA, 201 bp, Homo sapiens
tgttgttcctgcaataagtttgatttaaactctggaaaactgttttttaaaaaaattccatgtcgatcactagcatccctctcccactcccctctccctaycccgataagccttcacatttattttgagacagaaaagagaatggctgggctctgattctgactgccaagcttatagatatcccagctctagagctgcgtg

SEQ ID NO: 3743 - DNA, 201 bp, Homo sapiens
caagtttcttaccttctctgtgcttcatttcctcgtctgtcaaaggaggatactaatagaagcgacttcaaaaggggtattctgaggattacgtgagataycacctatgtaatagatgatgcgtgtgacatatttgttaaccgcacctggcaggaactgctccctcctcttgccacctcagttcatgaataataggtgtga

SEQ ID NO: 3744 - DNA, 201 bp, Homo sapiens
ttgctacatgcagaaggcaagcatgccccgtcacgtacagttgctgaggctgcctgccttcttcaggcatgactgtagggcttgacaagtgacaatgatgrtttaaaatgcacacaatgccagtgttttcattatgatctctgttagttatgctaaggtatctgcaagaacatccaaagtcggggccccaggaatacacag

SEQ ID NO: 3745 - DNA, 201 bp, Homo sapiens
tgccccgtcacgtacagttgctgaggctgcctgccttcttcaggcatgactgtagggcttgacaagtgacaatgatggtttaaaatgcacacaatgccagygttttcattatgatctctgttagttatgctaaggtatctgcaagaacatccaaagtcggggccccaggaatacacagatttcaccttctgcctttctttc

SEQ ID NO: 3746 - DNA, 201 bp, Homo sapiens
tgtaacaagtgtttgttcatctaccctgcatgtactggaagagataaaagttggaaaatagatcaaaacgcacgtacactattatttttctcttcaaggcyggcagaaaaagcagccttggagtgggctcatcagtgagcaagcccctgagctgggaggtggaggttggatgcgtctgcattcccactcggtgttgggacc

SEQ ID NO: 3747 - DNA, 201 bp, Homo sapiens
acacctgactacatcgccccagaggtaggaatgcagtgacaggctgctcccacctcaccatgccctggccacatgccattgcttctttagcccctgaaaakcagaaggttttaaatatcttcattcaagatttgtacctgttttcttaagtatctcataaacgccaccatgcatgtgggtttctattattattttgtgggg

SEQ ID NO: 3748 - DNA, 201 bp, Homo sapiens
gtggatcacctgaggtcaggagttcgagatcagcctggccaacatggtgaaaccttgtctctactaaaaatacaaaaattagctgggcatggttgcgggcrcctataatcctggctactcgggaggctgaggtgggaggattgcctgagcccagaagtttgagactagcctaggcaacatagtgaaaccccatctctacaa

SEQ ID NO: 3749 - DNA, 201 bp, Homo sapiens
acaattacaagagcccgaccttctgtgaacactgtgggaccctgctgtggggactggcacggcaaggactcaagtgtgatggtgagtccagtgggggatgwgcatggcccgacgtggaccccctaggggatggagcaaggctttctggggaactggagggaggatgtagggggtaccacttccacacccagcccagacaag

SEQ ID NO: 3750 - DNA, 201 bp, Homo sapiens
gaatgagggaaaacttctaaggagacttgagccatgggaagaattaatgagggaaccagggaatgaatgaggaaagtggatggcaactggggcatccatcmccacctctgcagttcccagtagattctcagcatatgtgcaataaccaaatcaatgaataaatgcacttacctaagataaagagaagccagaccatggcaa

SEQ ID NO: 3751 - DNA, 201 bp, Homo sapiens
tggtcttgatggacgatgatgttgagtgcacgatggtagagaagagagttctttccttggcctgggagcatccgtttctgacgcacatgttttgtacattycagaccaaggtatggcttctgctccgacaaccctacctcccctctaacctgtctcagcatgataccttcaatggcgccctcattaggagacacgagtcat

SEQ ID NO: 3752 - DNA, 201 bp, Homo sapiens
ggaaggcggcacagcatcttccgcattctccccttcttcatcccaatcctgttcacatgtctggtggaacccagagcgacctctcagtggaggcaggaggrgttaggttttcaaatcattacctaaagcagacatcacaggaggccaacattagcctcaagaatccgttcctggccccaaaggacactgacacgcttttct

SEQ ID NO: 3753 - DNA, 201 bp, Homo sapiens
tagcgaaaaattggaaacaacacaaatacccaatgacagatttattgaataaattattatatggtcagagaaaataatactatataaccattttaaatgawgatgtaaatgcttaaacatcaatacagaatgttgtttatgaaatcataagtgagaatatatagtatttccttttaagcaagaacatttgcatgtataagc

SEQ ID NO: 3754 - DNA, 201 bp, Homo sapiens
agagaggaagttgagactgctaagaatttgccaatcagatacaccgggtgattgcacaaacatttcacccggaactttaaaagattctcctactttttttwaaaaaagcgaaaaaacttcactttacaatagcatgttgtttggtctttatatttttttggtagaacggagcctttgaagattttcaagtactcagataac

SEQ ID NO: 3755 - DNA, 201 bp, Homo sapiens
aggccttaaagaaagatgtggtcttgatggacgatgatgttgagtgcacgatggtagagaagagagttctttccttggcctgggagcatccgtttctgacrcacatgttttgtacattccagaccaaggtatggcttctgctccgacaaccctacctcccctctaacctgtctcagcatgataccttcaatggcgccctca

SEQ ID NO: 3756 - DNA, 201 bp, Homo sapiens
gcttagaacttcccaggggttcctgggcgttatttcatggctcttctgcctgcttcgtttcatttctttcctcgaatactctttcctttccgctccattcygttccccgctctctcctaccacctacatttcaagtgctcccctcccctttttcttttgtcccctctcctctccctcccctgccctggtttgttttccatt

SEQ ID NO: 3757 - DNA, 201 bp, Homo sapiens
gaataaattattatatggtcagagaaaataatactatataaccattttaaatgatgatgtaaatgcttaaacatcaatacagaatgttgtttatgaaatcrtaagtgagaatatatagtatttccttttaagcaagaacatttgcatgtataagcatgaaaaataatgaaaaactaacagttgttaattgggaggtaggat

SEQ ID NO: 3758 - DNA, 201 bp, Homo sapiens
taagcttctttgcacacacatgtgcaaatcagcagataagattaagactgcatgatgtcatagcacctggtgcctgcttctattacaacactctctactcrcagactctgtcagctggagtttggaaatctttatatctgatttttctgtattttaatggtgatgtttctttttttttttttttttgagacacagtctcgc

SEQ ID NO: 3759 - DNA, 201 bp, Homo sapiens
atgatgtcatagcacctggtgcctgcttctattacaacactctctactcgcagactctgtcagctggagtttggaaatctttatatctgatttttctgtaytttaatggtgatgtttctttttttttttttttttgagacacagtctcgctctgtctcccaggctggagtacagtggcacgatctcagctcactgcaacct

SEQ ID NO: 3760 - DNA, 201 bp, Homo sapiens
aggaaagaaacaaaggaagaagcttgaatcaccttttccaacaccccgagttgttgtttttgagatgtcttaattattcaaaccttgcttgtcaaagtaastgattaaataccacaagtgaatgcaaaaggcaacgattgatacgtgatatggataatgctttgttctgggaacatgttgggaatgacctttcttgggagg

SEQ ID NO: 3761 - DNA, 201 bp, Homo sapiens
cacttgttattaattagggtcatttggattaaattgttaaagtttttaaagttcctagatgagggatatatcacctatggaagggtgaaaatatgataaakccatttaggaagctacaaaatgtgaaaattcctgtggacttggattccgaagttcaagcccagctctgccgtttatcaacagggctctgaggcacccact

SEQ ID NO: 3762 - DNA, 201 bp, Homo sapiens
ctggtctcaaactcctgacctcaggtgatccacccacctcagcctcccaaagtgacgggattacaggcatgagccaccgtgcccagcccctctttgcttckaaaacatcaatcagctccatgtgatgactcctgctgttttatggtttgtataaatgtatggggtgcaggtgtcatttcgttacctatgtggattgcacag

SEQ ID NO: 3763 - DNA, 201 bp, Homo sapiens
ctgctataacaaaatctcacatactggctggcttaaacagcagaaattcatgttctcgcaggtctggaggatggaagttcaccatcaaggtgttgtctggsttgtttcttcccaggcccctctccatgctttgcaatggtcgccctctctccatgccttcatatcatcttcctcctgtgcatgtctgcatccaagtgttct

SEQ ID NO: 3764 - DNA, 201 bp, Homo sapiens
acccctgcccaggacagagagtaagagttacaggcagaggggctgggagctgtaaaaccaggggccctaatgggacggcaccgtctggggacatagatgtrcaggataattcatgaaatctgaacctgaatctgaatgaggctcaaatcaaaagaatcttcacaatgaattttctgtgtgctagatcaaaatgactttgta

SEQ ID NO: 3765 - DNA, 201 bp, Homo sapiens
tggagtgcagtggtggtgcgatctcggctcactgcaacctccacctcccaggttcaaatgattctcctgcctcagcctcccgcatagctggggttacaggygtccaccaccacacccggctaatttttgtatttttagtagagatggggtttcactatgttggctaggctggtctcaaactcctgacctcaggtgatccac

SEQ ID NO: 3766 - DNA, 201 bp, Homo sapiens
ctagtgttcctggattcacatcactgcccttgactcccacactcccaatatgcaccagttgaacattcttggtcaatatcactttgaaatttttcttttakgaaaaagaaaactgagtttcactttctattcatagaacacacaaagctctacttccggttatggcttcagggcatgagtgtgtgagttactttgaacaag

SEQ ID NO: 3767 - DNA, 201 bp, Homo sapiens
tctccttcaagagagtgcctcaggaaagtgcatgccttctgtgaatctactatccctcttttgttttttgttgttgttgttgtcattgttgtgtttgtttstttgttttgagaaggagtctcactctgtcgcccagattggagtacagtggaacgatctcggctcactgcaacctccatctcctgggttcaagtgatcctc

SEQ ID NO: 3768 - DNA, 201 bp, Homo sapiens
tttctaaaaataatgatttttaaaagagtagagcaaagttgtgggtttgccagccttaaccattccctgtgattgcctggatagacatgggccatatccgygctgaagggggccaggctcatggacttcccaacagattccaccccagagaacgcacaggctattagtcatgatagcgaatggccagaagaagcaggtgca

SEQ ID NO: 3769 - DNA, 201 bp, Homo sapiens
gtaggagcatgtgccgtggacacgttcccgccatggccgctcagcaaggatgtccatgcacttctgctgcttcacctgtggcagccctatgggaaatgccsggatgtatttctgagcaccggccttgcccttggctttcatatccatgcccacaccccctatctttgagatatttatttaatgcatttgtattatgcagat

SEQ ID NO: 3770 - DNA, 201 bp, Homo sapiens
gggccaggcaagatcaaggaggggcagcagagggcacttctgggcgagcagtacagtggcatcgcagaaggacaggtgggaggggaagggataggctgcakcagctgcctttgaaaacgccatcgagcaatagtattgcagccatttataccataatatttcctacagaggacctcgtttagtttccgagattgagcctct

SEQ ID NO: 3771 - DNA, 201 bp, Homo sapiens
ccacgggctggctggattgggagactccggtcatttctgcaaggagagcgccacaggactgccttgttccctgggctgtcctgcccctgtgcgggctggaygtggtgctataaaagatgattcaggagtggcacaggctgagggggactaggctggagaaggtggagggaagagggagcactccgtgccctcttcctgtcc

SEQ ID NO: 3772 - DNA, 201 bp, Homo sapiens
gagaaaatggtgtttacttatttatttttttttattttgagacacagtctcactctgacgcccaggctggagtgcagtggcatgatctcagttcaccacarcctccgcctcccaggttcaagcaattccccacctcagcctcccgagtagctgggactacaggcacccaccaccatgcccggctaatttttgtattttttt

SEQ ID NO: 3773 - DNA, 201 bp, Homo sapiens
ctgaaccccacctccagagttgagtcccacctcctacctcacttcccttccagcacgaggatcactaccagggagagccagggtcaacttcctcccagccrtggcactttaggctttcctccctatccgcaaggctctgtcttacctccagagagagttgtttagcaccagggggttcttccactcttgctcactatctgc

SEQ ID NO: 3774 - DNA, 201 bp, Homo sapiens
catgaaaaataatgaaaaactaacagttgttaattgggaggtaggattataactgattttatttttattatatctttctgtgtatgttactataaacacaytttagactgggcttctgggcacttaggcagttgtgcttctcttggtgccttttccccatttttttttttttttttgatttgcatgtatgacagttttcat

SEQ ID NO: 3775 - DNA, 201 bp, Homo sapiens
gcctcaagtgatcctcctatctcagcctcccaaagtgctgggattacaggcatgagccctcatgctaacctatttgttgcttttaaagcattaatcatggrataagaaaaaggaataagttattcttctgctgtataacactctgtaaatgaagaggtcattcctaaaccatatcctggttttgttgttgttgttgtttgt

SEQ ID NO: 3776 - DNA, 201 bp, Homo sapiens
tcaaactcaaagtttgaggatggcccacctggaaacaccccaaaagaatgaagtcagagttgtaaaggagggaactttagggtttccatagggagagacasaggcatttttagcaggattacattttttcatacaaggctggtgcatagttccaggaacttggttacaggcagtgtttctttttgggaaagggacatttaa

SEQ ID NO: 3777 - DNA, 201 bp, Homo sapiens
agatggggtttcaccatgttggccaggctggtctcaaactcctgacctcaagtgatccacccacctcggcctcccaaagtgctgggatcacaggcatgagycaccatgcccagcctactctccctcctttgaaaccttgctgacaaactacctactctataaatcacgctcagatacactaaatcctacttgtcattcaga

SEQ ID NO: 3778 - DNA, 201 bp, Homo sapiens
ttggtctgtgaccctcccctcaaacagtcaccttctccctaaagttgccaccggctttaggaatcacctgctgttcccttccctgtgcaaccacagcaccyctacatccacctgaccaatccattgagcttctccccatcagggaccatggcttatccactcacaggctggagcagcagccctcagctccttcctgaataa

SEQ ID NO: 3779 - DNA, 201 bp, Homo sapiens
gattttttttttttttgcgacagtctcactctgttgcccaggcggctcaatacaacctccacctcctgggttcaagtgattctcctgcctcagcctcccargtagctggggttacaggtgtgtgccaccatgcctggctaatttttgtatttttggtagagatgggatttcaccatattggccaggctggtcttgaactcc

SEQ ID NO: 3780 - DNA, 201 bp, Homo sapiens
ctcaggctcccaaaatgctgggattataggcatgagccaccgcgcttggcctctgccttgatccttgatggcaaaatcgttcttctccatctccttgtctytcccccttaaaacttctgtcacttcaggaacctcttctccaccaccagtcttagagaaatatctgataaatagcatagagcagtttaatatgtgttgttc

SEQ ID NO: 3781 - DNA, 201 bp, Homo sapiens
ttatatttgtatttaccttttatgatgggattttggattcagcttttaaaaggcttatccatccctcaaaatgtgctcctcaaaatccaaacctctggacygtgtagtttgtatgtgcatacatttgtgctaattttatcacagagcagaacagatatttgacagatttattgtggagcctgcagttctcttgggagggtt

SEQ ID NO: 3782 - DNA, 201 bp, Homo sapiens
gggttccgcccagcccctcacttagaatcctccctttggcctttctcaaaccacactccttcctgtgaagccaagaggtcgtctctgttcctaaactactycccaggacctcggaattccatacctaaacagcctcaagcctgtgtagacatctccctaggttctgtccttgaaaggggcaggaggagactttcccgatat

SEQ ID NO: 3783 - DNA, 201 bp, Homo sapiens
tttcatttctctgtgatttaaaactaactacttagtttcttaaggaaccatcccgattcatcaggcttctaactaacctgagcacagaagcaaatatgtamcctttggaaaggaagcagtgaaatggactgcagacctcaagggtggtccccagggatggagcttgtagctgaggcatcttatggaaagcctgatgtggag

SEQ ID NO: 3784 - DNA, 201 bp, Homo sapiens
ttttctggagagggagtctacaaatctgatcttatttgcatgatatttgccaagttctcagtgcatttacaaaattaactgttattagtctgataaaaatmatgagtttatttctttaatgctataaacctgtcattcatcctataatatatgcacatttgccagccatttccttgtttactcaatatttgattagctgtg

SEQ ID NO: 3785 - DNA, 201 bp, Homo sapiens
tgccctgtggttgggtgatatgtaatttgaatttagccttggcttctattccatgaggaatgatgtcttttagcttacatggcattgttgaactcacagarcgaggcttattgattaaataactttctgatcgtagaaatctatgtttcattcagtttggcacagatacaggttttgatgctataaaccattttcatttga

SEQ ID NO: 3786 - DNA, 201 bp, Homo sapiens
aattatacaactgattttgttaaatctatcactttgatcttgtatttaatcatcattttttttaagacagggtctcactctgttgcccaggctggctttgkactcctaggctcaagtgaacctccagcctcagcttcatgaatagctgagattacaggcatgcacctctgcacccaacttaaataccatttctttaaaaca

SEQ ID NO: 3787 - DNA, 201 bp, Homo sapiens
ttctgtggtgaccaggcaaggagtctcactgtcagaccagaacaatgtttctactattacctcctatgccccacggcctcggttgggttcacatcaaaacrtaaaggttaattctgttaagaaaccacccaggtgagactttcagatgcaaattcatgcccagacgcaccgaaggtcctcacactttatggattactgatt

SEQ ID NO: 3788 - DNA, 201 bp, Homo sapiens
tcaaaaaaaatattaaagaactgaaactcaccagatcatggcatccagagactgaagcgccaggcccctggttcatcatgattgcttacttacccctcccragttcctgttttctcatacaaagttacatttcttccctgctatataaatccctagttttagttggtcatggagatggacttcagactgagctctcatctc

SEQ ID NO: 3789 - DNA, 201 bp, Homo sapiens
tgaacgaaagggggcctgcggggagggaagaaggtggaaagtttttgtattcttggtaaaaaaaaaaaaaaaaatgcgtgaggaaacatgttttctggagrtggtatcctgtccacaggggagcataaccccttttctgggaatgtattggagcacggacgggggtgccattgctcaggcttctaaacaagccaagtttct

SEQ ID NO: 3790 - DNA, 201 bp, Homo sapiens
cattttcaattattaaaaataaattcatcacgcctgtaatcccagtactttgggaggctgagatgggcagattgcctgagctcaggaattcaagaccagcmtgggcaacatggtaaaaccccatctctactaaaatacaaaaaattagctgggcgtggtggggcgcacctgtagtcccagctactccggagggtgaggcag

SEQ ID NO: 3791 - DNA, 201 bp, Homo sapiens
atggcaatatattctaacatgtattgacttgtcactatcggccgtttgctgtgctaagcactatatgtagatgattgcttgggtgctttgagaacatgtaraagggaaccaagtcctgattcggaggttcaggaaaggctttcagaggacaaggtatcgcgggtgggaatggaagatgtatgggaattagccaaaaggaca

SEQ ID NO: 3792 - DNA, 201 bp, Homo sapiens
ttcactctgaagctgcagatgctgtgttatagggtgttaaagtctctacagtttctatcaatgctgttgcattcatgttttattgcttctgccaaaatacragtatttcaaggatgaagttcatgttctcccaccagctcttgtctaaaatccatgctcaatgagtatttactgtatgcaggttattactgaagagaggac

SEQ ID NO: 3793 - DNA, 201 bp, Homo sapiens
ttgaaccttggttctccttcccccaggttttatgctgctgaaatcattcttggtctgcagttccttcattccaaaggaatagtctacaggtaaattttgckttgtggaaacaaatgctaagatatcggctttcctggctcagttaatttaatcattgcaccgagtgctgtgagacagcccatgtgatttcctgggagtaag

SEQ ID NO: 3794 - DNA, 201 bp, Homo sapiens
gtaattttttttggtctatctacaaaatcatagattaagaatctgttttataattttttaatcttcaggaaattgagaaatactcaccagaatattatttwaaaactcttagcagaatttttttaaatttttctttatatgtgtaaggcctgcaatgtatctaaaatatttttgtacctaggcactgactaaattgtgtgg

SEQ ID NO: 3795 - DNA, 201 bp, Homo sapiens
gcaccctgtcactttcaataagtatacaatcggcacatgctaagtgccctaagtgcctggcaccatcccattgtctggccagcaggtcaactggactctcscttgtgccccccgctcatctgctgggttgtaacacgcaagcatctagatgccacagggcatcccacctagattccccaggcttcctggggctcaaaaaca

SEQ ID NO: 3796 - DNA, 201 bp, Homo sapiens
cttgcagagtttggcatttcctttcccccagccttaaaacatattcactctgctcagacctaccagaaggaacagctagtgaagagccaggtggagcaagygtccacccaagtcaagtggtgaaactgtggggtcagaagacctggactgagtttctaagccaccactgatgtaagcacagagtgattgccaaagtctcac

SEQ ID NO: 3797 - DNA, 201 bp, Homo sapiens
aggcggaggttgcagtgagctgagatcacaccattgcactccagcctgggcaacagagcaacagtccatctcaaaaaatttaaaaagttaaaaaaaaaaarggggaagtaggaataaaaattaggagggactggagagagagagagacagagatcttagactggaagggaccccgtgaaacctaaacccacatgcctcggg

SEQ ID NO: 3798 - DNA, 201 bp, Homo sapiens
taagatatcggctttcctggctcagttaatttaatcattgcaccgagtgctgtgagacagcccatgtgatttcctgggagtaagctccacacataggtctsctgcccacaatgattacatggatgatgacttacaaccaaggaagacattccagtctcaacagcaggaaagtgctgagctcattctgtcctttatgctggt

SEQ ID NO: 3799 - DNA, 201 bp, Homo sapiens
gctttcctggctcagttaatttaatcattgcaccgagtgctgtgagacagcccatgtgatttcctgggagtaagctccacacataggtctgctgcccacartgattacatggatgatgacttacaaccaaggaagacattccagtctcaacagcaggaaagtgctgagctcattctgtcctttatgctggttctcacttga

SEQ ID NO: 3800 - DNA, 201 bp, Homo sapiens
gagggttgccctatttggagtcacacaactaaaggcttagaggaggtttgagaagtaagtattcttaagcagcctctttgaatgtaattttttttggtctwtctacaaaatcatagattaagaatctgttttataattttttaatcttcaggaaattgagaaatactcaccagaatattatttaaaaactcttagcagaat

SEQ ID NO: 3801 - DNA, 201 bp, Homo sapiens
aagcagaaaaacacctgaaggttttagtttacaataaactcaatattgggcattactgtgatgaaactatgaaaaatatggtgcaggatcttagtccaccrtggcaaaaggcaagaggatggtaatggagctctgggtgccgctgtaacctgcaccaatcagattgtctctctggaggattctggcttcattctgagccaa

SEQ ID NO: 3802 - DNA, 201 bp, Homo sapiens
aggcaagaggatggtaatggagctctgggtgccgctgtaacctgcaccaatcagattgtctctctggaggattctggcttcattctgagccaagtcagtcragaagaaaacggacaaattcaagatatttggaaggtagaggccagaatgtttgcccttcatccagtttcccccagtggccacatctcatgcagctgtggt

SEQ ID NO: 3803 - DNA, 201 bp, Homo sapiens
ttgtttgataaagactctggcagacctctgatttcctgggtaaaattattcagcagcaagttcctgtcattgccaaaggagttgtggccatctgagtcctrgaactatgtagctttgccctgtggttgggtgatatgtaatttgaatttagccttggcttctattccatgaggaatgatgtcttttagcttacatggcatt

SEQ ID NO: 3804 - DNA, 201 bp, Homo sapiens
tcaatttctttcctcttcaccttgcaacaccttggtgtggctgccttactctgatgtattcctgtctacagattttgggtgccgggtcttttccacggcawaccttccttcccgatttccatctgcttcttgcagaatccggcttccacagcttgcttctctctgcagcttcactcccttcttttcttttacgtgtgcttg

SEQ ID NO: 3805 - DNA, 201 bp, Homo sapiens
ctgcccatgcatggaagttatgttctttaagccttcttaggcaccaacaagaaaaaaaaatgagtttattttttgtgctcattaggttgcaggagaccctwgaaagtcatcatcaaatagttataactgaggataggtcaccagacaagtatgctggctttaaaactggcctgctgcataataagaaataagttgccttat

SEQ ID NO: 3806 - DNA, 201 bp, Homo sapiens
aaaactaggaattatacaaatttcccctttctttcttacccttcaaatccacccaaacaccaacaccttctataattggaccctctcatgtccattcactsccctaaacttgtgactgaattcagactctcccttgattccttctccaagctcaaacaaatccccttgatccagctccgcccagatctccaggtcctctcg

SEQ ID NO: 3807 - DNA, 201 bp, Homo sapiens
tggcgtcactcaccatctgccagaggaaccacaaaatcgacggcatcttcaaagatgatgtaagccctggtttgggtcaaatgtaaaaccacagagccggraagtatgcagatgtggaaagaagaatctagaacttccaatcttagagtattagaactaagaagaaccttaagattatattttattgacaataaaactggg

SEQ ID NO: 3808 - DNA, 201 bp, Homo sapiens
ctcctgagtagctgggactataggcacgcgctgccacacccagctaacttttgtatttttagtagagatggggtttcaccatgttggccaagatggtctcratctcttgacctcatgatccacccaccttggcctcccaaagtgctgagattacaggcgtgagccaccgcacctgggcttttttaaaaatcttctttatag

SEQ ID NO: 3809 - DNA, 201 bp, Homo sapiens
ttccagcatgtggcatgaatgtgcatcatagatgccagacaaaggtggccaacctttgtggcataaaccagaagctaatggctgaagcgctggccatgatwgagagcactcaacaggtaggagcatgtgccgtggacacgttcccgccatggccgctcagcaaggatgtccatgcacttctgctgcttcacctgtggcagc

SEQ ID NO: 3810 - DNA, 201 bp, Homo sapiens
gggtcaaatgtaaaaccacagagccggaaagtatgcagatgtggaaagaagaatctagaacttccaatcttagagtattagaactaagaagaaccttaagwttatattttattgacaataaaactgggcccaacccatgtgtttgaagccactttcaatgctttcacgtgattctcattggacgttacaggaccccatgag

SEQ ID NO: 3811 - DNA, 201 bp, Homo sapiens
ccatgagggctggcattttgtccctacatgtgtccccagccactctaacagggcctgacacataccaagttgtgaacaaatatgtgcagaatgattgtgtwagtgtttcagtaggggacacacttggtattatgtgcacagctagatttggggtgtcgcagagctgtcagtgacggctcaactgagacctgaaggggaagt

SEQ ID NO: 3812 - DNA, 201 bp, Homo sapiens
gggttcttcttttctttctgtggcttgagaactcatttttcattgctcagtaatattccattgacaactaatgatttgttatgttcttttgttttccttawaatgacagactccatggatcaagaattttagagtagggaggggtggtagaggttatcaagtcagatcccctcattttgcagcaaaggaaatggagctcca

SEQ ID NO: 3813 - DNA, 201 bp, Homo sapiens
taatgcaacttaatgcttttcttccctgtgtgataaataataacaatgtatgtgataaagttaatacataaggagttcttgctatatgccaggcacagggytaaatactttatatgaattctttcatttaattttaaatatgaacgatagctcccctttcttcttcagagcagaattcccaactctttccatcggctgtcc

SEQ ID NO: 3814 - DNA, 201 bp, Homo sapiens
aagtatggtcttctggggcaataagccactatgttcctttccttgcaccctgcaacacccccacccacacatcccagaaaagagcacaacagttcaggttsaaggtcaaactcctagctccatcaccttctgccgtaccatagccctgggggaaatgaagacagtgtttctcctctcactggtctttctactactagtttc

SEQ ID NO: 3815 - DNA, 201 bp, Homo sapiens
catagaatactatgtagccataaaaaggaatgagatccctgtcctttgcagggacatggatagagctggaagccatcatcctcagcaaactaacacaggakcagaaaactggacaccttatgttctcacttataagtgggagctgaataatgagaacatgtggacacagggaggggaacaacacacactggggcctgtcgg

SEQ ID NO: 3816 - DNA, 201 bp, Homo sapiens
ggagtcgaaagacaatagctaagtaaataacacacaaataaggtaaagtcaggcacctcaaatacagtgacttgaccactacacattctgtgtacgtaacraaataccacatgtgccccataaatatgcaaaatatgatgtatcaataaaaacaaacacacacaaaactcaaagaacaataaaacaaagacggtgaagagg

SEQ ID NO: 3817 - DNA, 201 bp, Homo sapiens
cccaaagtgctgggattacaggtgtgagccaccccacctatcaagggaagatattttcttaaggggagtatgtaataacaaccatgtccctggtttgttargaaggttataaactttgaaatatacccatcagtttcataaagagcaagacaggttaggaagaaatagtgttcattatacagactagagagctttcagctt

SEQ ID NO: 3818 - DNA, 201 bp, Homo sapiens
taacatgtcagggctttttctgggcgtttaaaatacaggggagaagagaaggagaaaggtactgaccctcgtcaagcctatgcctacttttttttggagtmgaaagacaatagctaagtaaataacacacaaataaggtaaagtcaggcacctcaaatacagtgacttgaccactacacattctgtgtacgtaacaaaata

SEQ ID NO: 3819 - DNA, 201 bp, Homo sapiens
ccttgtaggagaaaagactggagagaggccactgaatctcgttgtgtcattcaccctacctagtcctgctctgccagggtcatgctcaccttccagacccmcccaacagtgaagtcggactgaaaaatcccagaagtgggaattgggagacaaggttgagtgcattagggggatgtctaggattccccctgattcgaatat

SEQ ID NO: 3820 - DNA, 201 bp, Homo sapiens
ttctccctcctcagtgccttagagaaatgttagcctctcttgtgtgattctaagtcgatgctgccctgcagggtctttatgagtgttccgctgctgtctcwcctacaaacgtgtctgtaagcaccttcagggaggggactctgtggcctggggaaggccgactaggtgaggcagagaattaaaacacaggaacacacaact

SEQ ID NO: 3821 - DNA, 201 bp, Homo sapiens
acttcccagcttctgaggctgaaggagaacagatgaggcttgctctggcgtcgttcggtgaaaccactgttcctctctcgctgctttcccgggtttccttrtgcattttgagctgtgcatctgattctttgggtcaaagcaaggactgaaaaagagcagaacacaagaagagatcacaatgaggcaaggtcccggggctga

SEQ ID NO: 3822 - DNA, 201 bp, Homo sapiens
gagggagcactccgtgccctcttcctgtccatgggaaatgaaccatctgtgcctggtgtccaagtccttgacgttccagttgccctttgagagcacacctyaagcctgctgaattcttttaagaaccacctacaagatctgagaagtccgcccatgctttctgtcaactccggcctctttgaccttttcttttgccaaaga

SEQ ID NO: 3823 - DNA, 201 bp, Homo sapiens
agctggccaggcgcagtggctcacgcctataatcccagcattttgagtctgaggcagaaggattgcttaatgtcaggagttcatgaccagccttggcaacrtagtgagaccttgtctctacaaaaaattttaaaaattagccaggcatggcgatggcacacatgtggtcaagagtctgaggtgggaggactgcttgctcaa

SEQ ID NO: 3824 - DNA, 201 bp, Homo sapiens
aagccagaagtagagcctgtgacgttttacatggccagaaaaactcttgtgctgctgttgatattgttcttctgtttgtttagcaagtctgccttagagaracttcacagcacccctgggcctcacttagcactgatctgtctcccaggagtgggccccggggtggtggagggtcagggatggggttgccgtgcacatcag

SEQ ID NO: 3825 - DNA, 201 bp, Homo sapiens
agtggctcacgcctataatcccagcattttgagtctgaggcagaaggattgcttaatgtcaggagttcatgaccagccttggcaacatagtgagaccttgyctctacaaaaaattttaaaaattagccaggcatggcgatggcacacatgtggtcaagagtctgaggtgggaggactgcttgctcaagaggttgaggctgc

SEQ ID NO: 3826 - DNA, 201 bp, Homo sapiens
aacttcttggagtgtcattctctccatttgcaaagtgaagaaaattgtgatctctgatagcagtgatgctgcgagaaaggagcatgtgccagtgtgtgggstattgctgggtggagctggaggagtcagctgtgccagatcacataggacctgtaagcaggtgaaccatatacgttatcctccagatggggactgtttata

SEQ ID NO: 3827 - DNA, 201 bp, Homo sapiens
ccaacaaaaaaataccttctgcgtgcgtgtgtgtgtgtgtgtatttatgtgtgtctgttcacagatgcacccagctaagcccaaacacattacaaggtagwacagatgttcatccccaagagagtctgactgtcttgcttttaagtttagtgcctcaatcctattattccttctccattttgttttggctaataaagcaac

SEQ ID NO: 3828 - DNA, 201 bp, Homo sapiens
gagtgtcattctctccatttgcaaagtgaagaaaattgtgatctctgatagcagtgatgctgcgagaaaggagcatgtgccagtgtgtgggctattgctgrgtggagctggaggagtcagctgtgccagatcacataggacctgtaagcaggtgaaccatatacgttatcctccagatggggactgtttatagagtgaaag

SEQ ID NO: 3829 - DNA, 201 bp, Homo sapiens
acataagcgcctctcgtgagcccctctcaggctgcaatgagacaaactccctcgcctcctatggaattttatgttaaccaaattatattgattaatgtgasatttgcttcacttttgtttttcagggacctgaagctagataacatcctgttagacaaagatggacatatcaagatcgcggattttggaatgtgcaaggag

SEQ ID NO: 3830 - DNA, 201 bp, Homo sapiens
taaagcaacttgcccgcaactcatccttggagcagcagtcatgaattaacgaagattttttttccctcttttccattaaaaaaaattttatgtgccactaytatgtcctagggttttgtttttaattgtgggaaaatacacgtaacatgaaatttaccatctgaactatttttgtgtacagttcagtaatgttaaaaatag

SEQ ID NO: 3831 - DNA, 201 bp, Homo sapiens
atcctccagatggggactgtttatagagtgaaagagcacgttattaatcactaagcttgggtaacaggtacaaacccagattgtcctgggcagactgtccygtagagttgtcctgcgttaagtcatatgaaggagtttgatccttttctaagaacaggaggaaccctttaaatgctttatctaccaatgtatacaagtgcc

SEQ ID NO: 3832 - DNA, 201 bp, Homo sapiens
agaaggttttcatcttgaaaaaccaaaactctgtccccattaaataccagctccctattccccctccccacagctcctggcagccactattccacttcctktctctagaatttaactattaggttggtgcagaagtagttacggtttttgtcactgaaagtaagggcaaaaacttctgttaatacttaaggtaccttatgt

SEQ ID NO: 3833 - DNA, 201 bp, Homo sapiens
gtgaaagagcacgttattaatcactaagcttgggtaacaggtacaaacccagattgtcctgggcagactgtcccgtagagttgtcctgcgttaagtcataygaaggagtttgatccttttctaagaacaggaggaaccctttaaatgctttatctaccaatgtatacaagtgccattcaggttctctccagcgtttcagag

SEQ ID NO: 3834 - DNA, 201 bp, Homo sapiens
gccatctcaatttctttcctcttcaccttgcaacaccttggtgtggctgccttactctgatgtattcctgtctacagattttgggtgccgggtcttttccmcggcaaaccttccttcccgatttccatctgcttcttgcagaatccggcttccacagcttgcttctctctgcagcttcactcccttcttttcttttacgtg

SEQ ID NO: 3835 - DNA, 201 bp, Homo sapiens
caaaactctgtccccattaaataccagctccctattccccctccccacagctcctggcagccactattccacttcctgtctctagaatttaactattaggytggtgcagaagtagttacggtttttgtcactgaaagtaagggcaaaaacttctgttaatacttaaggtaccttatgtaagtggaatcattcagtatttgt

SEQ ID NO: 3836 - DNA, 201 bp, Homo sapiens
tgaactcacagcactcggcttgcactgcaaactcacctatacgttggcagctgtctcctcactgggcacttaattcatgaacaactaggagggaaagacarcaagacagccaggggtctgctctttggctctttgcatttttttttacggggtcttgctctgtcgcccaggctggagtgcagtggcacgatctcagctcac

SEQ ID NO: 3837 - DNA, 201 bp, Homo sapiens
tggcttacttcacttagcataatgttatcaaggttcactcacgtagcatgtgacaggtttcccttcaccttgaaggctgaataatattcctctgtgtggakgtaccacattttcttcaacgccttccctatccctcctccctaccctctgcccagaccctggcgactgccactctcagcttctatgagttcaacgtgttta

SEQ ID NO: 3838 - DNA, 201 bp, Homo sapiens
cctcacttcccttccagcacgaggatcactaccagggagagccagggtcaacttcctcccagccgtggcactttaggctttcctccctatccgcaaggctstgtcttacctccagagagagttgtttagcaccagggggttcttccactcttgctcactatctgccttcttccttccagcatgtggcatgaatgtgcatca

SEQ ID NO: 3839 - DNA, 201 bp, Homo sapiens
acttataagtgggagctgaataatgagaacatgtggacacagggaggggaacaacacacactggggcctgtcgggaggtgggattggagggagggagagcrttaggaaaagtagctaatgcatgtggggcttaatacctaggtgatgggatgatgggtgcagcaaaccaccatggcacatgtttacccatgtaacaaacct

SEQ ID NO: 3840 - DNA, 201 bp, Homo sapiens
cacctcctacctcacttcccttccagcacgaggatcactaccagggagagccagggtcaacttcctcccagccgtggcactttaggctttcctccctatcygcaaggctctgtcttacctccagagagagttgtttagcaccagggggttcttccactcttgctcactatctgccttcttccttccagcatgtggcatgaa

SEQ ID NO: 3841 - DNA, 201 bp, Homo sapiens
cacacactggggcctgtcgggaggtgggattggagggagggagagcgttaggaaaagtagctaatgcatgtggggcttaatacctaggtgatgggatgatrggtgcagcaaaccaccatggcacatgtttacccatgtaacaaacctgcacgtcctgcacctgtatcccagaacttaaaataaaaataaaaattaaagaaa

SEQ ID NO: 3842 - DNA, 201 bp, Homo sapiens
tccagtgggggatgagcatggcccgacgtggaccccctaggggatggagcaaggctttctggggaactggagggaggatgtagggggtaccacttccacayccagcccagacaagtcatgatcataagtatggtcttctggggcaataagccactatgttcctttccttgcaccctgcaacacccccacccacacatccca

SEQ ID NO: 3843 - DNA, 201 bp, Homo sapiens
aaatataaaaaattagctgggtgtggtggcacgtacctgtaatcccagctgctcaggaggctgaggcagggcaattgcctgaacccgggaggcggaggttkcagtgagccgagatcgtgccactgcactccagcttggtgacagagtgagactctgactcaaaaaaaaaaaaattaagtgctaccttccctggccaggcca

SEQ ID NO: 3844 - DNA, 201 bp, Homo sapiens
ttggtgctgatgttgatgccaacattgaaataaatcagcgtgtgctttattacaggggcctgaacaaacagggctaccagtgccgacgtaagtaagagggktttggttgcattaccatcattctttttatttagttattccttaggctatgaaaatcttaagctgtgatttttttcttcttttcagaatgcaatgcagcaa

SEQ ID NO: 3845 - DNA, 201 bp, Homo sapiens
tggtttgttagtttgtttgtttttgaggcagggtcttgttctgttgctcaggttggagtgctgtgactcaatctcggctcactgcaacatctgcctcccargctcaagcaattattgtgtcagcctcgagagtagctaggactacaggcatgcaccaccacacctggttaatttttatgtttttagtagagacagggtttc

SEQ ID NO: 3846 - DNA, 201 bp, Homo sapiens
gtccatatctaaaggtgagttttaggggatctgactgagaagtgttccgggccagctccctagaaacccttgggtgcactgacttcttcctggccagtgtygtctgcttggtcatcagtgtgttcctcccctcctgagttctctccatctttctgttcttctgttttcttgcagtaatcgaggacaggtggtcgctggcac

SEQ ID NO: 3847 - DNA, 201 bp, Homo sapiens
taaaataaatgcaatttctttcaccaaaaaaaaggcgaacattgctaagcataaatgagcacttccttttagaaatgaataaagtaaaactcaaccattakcaacttcccatagctagagctcgcagaggaaaatgttaacacatagcatcatgtttgaattttattattttcatagagaagaaaaccagcaagcaaaccc

SEQ ID NO: 3848 - DNA, 201 bp, Homo sapiens
agacagaggttgcagtgagccgagattgccccattgcactccagcctgggtgacagagcaagagtctgtcttagaaaaaaaaaaaaaaaaagaagcccctyagttcctgtctgaggctcacctcccctggggccctggaatccatttctttcttgttcttgggaatctcaatctcttatcttccctgtcacctgcattttc

SEQ ID NO: 3849 - DNA, 201 bp, Homo sapiens
gcagctaggaggttgagattcccccaccccgtcttcctccatatgtggccccaaagtaggaagttcctgctgctttggtctttgggtgaaaaacaggtcaygggccaggcaagatcaaggaggggcagcagagggcacttctgggcgagcagtacagtggcatcgcagaaggacaggtgggaggggaagggataggctgca

SEQ ID NO: 3850 - DNA, 201 bp, Homo sapiens
gattcgaaggttctactcctttcctctccagccctcacatcgggttcctccaagtctgagcctctttaagctcctaggaggtcccagcatcccctcatctygtggacgtctgctcaatctctgagctacttcctgtacatcttcagctcccaagatgtctcttgtcctctggaaagctcttcctgatcctccacatcagga

SEQ ID NO: 3851 - DNA, 201 bp, Homo sapiens
attgccccttttgccctcaaaaaccaaacaaaactggagctgtgttctccctcctcagtgccttagagaaatgttagcctctcttgtgtgattctaagtcratgctgccctgcagggtctttatgagtgttccgctgctgtctctcctacaaacgtgtctgtaagcaccttcagggaggggactctgtggcctggggaagg

SEQ ID NO: 3852 - DNA, 201 bp, Homo sapiens
tcagtgccttagagaaatgttagcctctcttgtgtgattctaagtcgatgctgccctgcagggtctttatgagtgttccgctgctgtctctcctacaaacrtgtctgtaagcaccttcagggaggggactctgtggcctggggaaggccgactaggtgaggcagagaattaaaacacaggaacacacaactgctgggacag

SEQ ID NO: 3853 - DNA, 201 bp, Homo sapiens
gaggggactctgtggcctggggaaggccgactaggtgaggcagagaattaaaacacaggaacacacaactgctgggacagaggccatctggcaggcacccrtcgttcctgtgaggagaactcaaatctcagaagctcatgcatttcgtagcagagtcaggagctacacatgaaaaacacacctgtgctccctcaactgggg

SEQ ID NO: 3854 - DNA, 201 bp, Homo sapiens
ggaggaatccatatggcagagggcagagaagcgaatggaaggggaggaagcaaagatggttcaggaagctggttggcgaaggaagggaggtaaggccatarcagcgggagaagccacggcagaagttgttagaggttgcaaaaccggagggtgtttataagcgggagtgggagacaggcagaaatcacaagaatggcaagg

SEQ ID NO: 3855 - DNA, 201 bp, Homo sapiens
gggactctgtggcctggggaaggccgactaggtgaggcagagaattaaaacacaggaacacacaactgctgggacagaggccatctggcaggcacccatcrttcctgtgaggagaactcaaatctcagaagctcatgcatttcgtagcagagtcaggagctacacatgaaaaacacacctgtgctccctcaactggggatc

SEQ ID NO: 3856 - DNA, 201 bp, Homo sapiens
gcgtgccaccatgcccggctaatttatgtatttttagtagagacagggtttcaccatgttggccaggatggtctcgatctcttaacctcatgatccgcccrccttggcctcccaaagtgctgggattacaggcgtgagccactgcgcccagccggaaacatcatactttctatggcacactagacactcagtaaatccaga

SEQ ID NO: 3857 - DNA, 201 bp, Homo sapiens
aataattcttagagtaaaaagtttggttgggtgcagcgactcacacctgtgatcccagcactttgggaggccaaggcaggaggatcacttgaggtcaggartttgagactggcctgagcaacctagtgagaccctgtgtctacaaaaaataaaaaagaaactagctgggtgtggtggtgcatgcctgcagtgtaactagtt

SEQ ID NO: 3858 - DNA, 201 bp, Homo sapiens
gcagggcttgtggaaagggagaatggggagttattgtttaatgggtgcagaatttcagacttgcaagatgtaaaagttctggagatgaatgcccaacaatrtgaatatacagaacactgctgaactatacattgaaaatgattaagatggtgaatttcagccgggcgcggtggctcacgcctgtaatcccagcactttggg

SEQ ID NO: 3859 - DNA, 201 bp, Homo sapiens
gatatgtggttcagagacgtttctggttgctttgacgccgccttgtgggcaagtctcggaaattgcatgtgtccctggcccagcaaattgagcaaagattktattaggtgcatcttatatttccttatcattctccctgggtctaccttcagatgattccttaaggcaaagcctattttttctaaattataaagtaaactt

SEQ ID NO: 3860 - DNA, 201 bp, Homo sapiens
agatgctcagaaagaggaaataaaatgttacagatgtctttgttcgtctgtagtgagctcagcgaggccatgaatttttaaatctagcacagggaaacgtrctacgaagagtctgtgatgcatgcattttcattcatgcattttaatctctatatgtttggaaaatacaaggatgataaatcagccagttctcatttattt

SEQ ID NO: 3861 - DNA, 201 bp, Homo sapiens
tgtaaaagttctggagatgaatgcccaacaatgtgaatatacagaacactgctgaactatacattgaaaatgattaagatggtgaatttcagccgggcgcrgtggctcacgcctgtaatcccagcactttgggaggccgaggtggccagattaccagaggtcaggagtttgagaccagcctggccaacatggggagagcgc

SEQ ID NO: 3862 - DNA, 201 bp, Homo sapiens
aaattataaagtaaactttagcatgtaaatatcgaggtaagagtagtgggtagcatttttatattggaaatcagtaacattgcaaaattctgtttgcaacwttattttcagaaacggggacaagtgcatcatcaaagcagatatttatcataacatttatagttgtcccataagacaaatcatcttgactttgctactttt

SEQ ID NO: 3863 - DNA, 201 bp, Homo sapiens
ctgtcccatattgtctctgattgtttatgtgctacttttgtcttcccaacagaattctatatcccagagaacagagggagcaggtgctactgttgagttgractgaattattttccaggcctggctgaaggaataatgagaccttacgtttctgttcctagagaacgggcagatgtatatccagaaaaagcctaccatgta

SEQ ID NO: 3864 - DNA, 201 bp, Homo sapiens
tgtcccataagacaaatcatcttgactttgctacttttcactggatctcacaagaagcttataagaagcgggccagatatgattcccgtttttcacaaacragaagggtgaaagggtcctcccaaaactacacaataagggattaagccagaagtagagcctgtgacgttttacatggccagaaaaactcttgtgctgctg

SEQ ID NO: 3865 - DNA, 201 bp, Homo sapiens
aaggcaaaaacgtggacctcatctctgaaaccaccgtggagctctactcgctggctgagaggtgcaggaagaacaacgggaagacagaaatatgggtaacrttgcataaagtgtatgcacataagggataagcatgatggtagccgatgactggctcagaactcccatgtcaatctgagggtgtgattacactggcctcgg

SEQ ID NO: 3866 - DNA, 201 bp, Homo sapiens
ttccttggcactccttcctcacccccatggggggctggcttcacatggcagcctttcagaacctttcccatattgacctagatccctcagagctggccagkcgcagtggctcacgcctataatcccagcattttgagtctgaggcagaaggattgcttaatgtcaggagttcatgaccagccttggcaacatagtgagacc

SEQ ID NO: 3867 - DNA, 201 bp, Homo sapiens
gcataaagctttagggagcaggaagaggcacttagtccatctgagaacaaagcttctccttcctagtgccggcagcctgagacacctggagacggggcagsctgtgtgtacctggtgggactgcacctgcatccacagttctcaccaccactcctgcccatgctgttccctttgggtcccacttcctgctccccatgacat

SEQ ID NO: 3868 - DNA, 201 bp, Homo sapiens
atcaagctacgaacctgctccgtcgcttttaaacctagacacttacatgttcagggctgttgtcacatcattgacttcggcctttcccaaaagtcaataasagaaacaaatgacaaatgactgaattttagcaactgtgattcagagatcattttagagtctactttcccaggtctcatcttacctgactttcacaacagt

SEQ ID NO: 3869 - DNA, 201 bp, Homo sapiens
gttagttttccttctaacaaacaggaccctcagctgcaggtctgttggagtttgctagaggtccactccagaccctgtttgcctgggtatcagcagcggtrtctgcagaactatatttattaatactacaaaaatatctatgcttcatcaaaataatgagattaaatgactttttaaaaatcttggttttggccaggtgca

SEQ ID NO: 3870 - DNA, 201 bp, Homo sapiens; identical to SEQ ID NO: 876

SEQ ID NO: 3871 - DNA, 201 bp, Homo sapiens
accaaattatattgattaatgtgagatttgcttcacttttgtttttcagggacctgaagctagataacatcctgttagacaaagatggacatatcaagatygcggattttggaatgtgcaaggagaacatgttaggagatgccaagacgaataccttctgtgggacacctgactacatcgccccagaggtaggaatgcagt

SEQ ID NO: 3872 - DNA, 201 bp, Homo sapiens
gcagtgcagtggcatgatcttggctcactgcaacctccacctcccaggttaaagcgattctcctgcctcagcctcctgagtagctgggatcacaggtgcaygaccacactcacctaaatttttgtatttttagtagaggtggagtttcaccatgttggccaagctggtcttgaactcctgacctcaagggatctgcccgcc

SEQ ID NO: 3873 - DNA, 201 bp, Homo sapiens
catgatcttggctcactgcaacctccacctcccaggttaaagcgattctcctgcctcagcctcctgagtagctgggatcacaggtgcacgaccacactcasctaaatttttgtatttttagtagaggtggagtttcaccatgttggccaagctggtcttgaactcctgacctcaagggatctgcccgcctcggcctcccaa

SEQ ID NO: 3874 - DNA, 201 bp, Homo sapiens
ctaggttctgcagaaatacttatccttgcagatgtgtttggctgaaacccttgagatacaggcattcagtccagtccctggcctatatactgtaccaacgstgattctgcaagactctctcactgttggtttcctgcccagcagattgtcctgggcagtgtactagtctgttctcatgctgctgtaaggacatacctaata

SEQ ID NO: 3875 - DNA, 201 bp, Homo sapiens
ttgagatacaggcattcagtccagtccctggcctatatactgtaccaacgctgattctgcaagactctctcactgttggtttcctgcccagcagattgtcytgggcagtgtactagtctgttctcatgctgctgtaaggacatacctaatactgggtaatttataaaggaaagaggtttaactgactcacagttctgcatg

SEQ ID NO: 3876 - DNA, 201 bp, Homo sapiens
agaggtggaggaggtggaagggaggcaggagaggcaggcacacttggtgtaaatttgattgaaaaaatctacatattagtggactggtgcagttcaaatcyaggttcatcaagggtcaattgcacttaaaatacctacagaccagctctccccaacctgccctacccactgtccaccagaaatattgttgacttcttcact

SEQ ID NO: 3877 - DNA, 201 bp, Homo sapiens
cacaggatccccagcccaggggtaaaggaacaagatgtttaaaaatttgagccacttccattcagctttcactttctgactatgatccaaacaagcaatarcttagaaaactccctcaacaatcaattaaaggcacttttaatgaccaaacacagataaaatgaaaactaatctcaaaattaaccaatttttttaaaaagg

SEQ ID NO: 3878 - DNA, 201 bp, Homo sapiens
tcctgtttgtttgtttcttggtttgtttgttggtttgttagtttgtttgtttttgaggcagggtcttgttctgttgctcaggttggagtgctgtgactcartctcggctcactgcaacatctgcctcccaggctcaagcaattattgtgtcagcctcgagagtagctaggactacaggcatgcaccaccacacctggttaa

SEQ ID NO: 3879 - DNA, 201 bp, Homo sapiens
tcttcccttctacttctattcttagaccctaagactctgggtctccaagattatgagttctcacaagtggttcctgcttcttagccttcaatttccttgayatctctctatcatacaatgctgaaaacttcatttcttttcagcttgcctgatgtgatattgtccaggttttcctcttaatttttcagctgcctcttcttg

SEQ ID NO: 3880 - DNA, 201 bp, Homo sapiens
cctgaactccaagttctcaccatggcctgtggacagccccatgggcacacccacctcgtctgtcttctctaccccttgctcaactccacgcagcccatccsccttcccagaacgtgcttggcagctccgacctcacacccatgtttcggccgggaacgttcacctgccattgtctgtgtgactcagtcctctcctcgtgca

SEQ ID NO: 3881 - DNA, 201 bp, Homo sapiens
ggttaaacaacagacatttctttctcacagttttagaggcagaaagtccaagattaaggtccagcagtgtcagttcctgatgaggactctcttcctggctkgtagacagctgccttcttgttgtgtccttacagcagagagagagagagataaactctggtctctctttcatgtgagacttctagccctattggatcaaga

SEQ ID NO: 3882 - DNA, 201 bp, Homo sapiens
tgggtgattacaacattttcaaggattcttccccagggcagctgcttgtgggagagctgaggtctagaaaggaggagttgagagcaggaaaggaaccaagsctgaccccacccccatgccagcattttgatttatggaaccctgggagaagagtttctccaaaatgatacttcatggcctccagcagatccccctcaaaga

SEQ ID NO: 3883 - DNA, 201 bp, Homo sapiens
tccatttttccttttgacatcttcgatgatcaagatacctgctaaggatttgttcagaaatcagaattagttgtaaggcagttgcctgaacaactgaaagygtaatgaccccacagagagcactaaggcaacagaaagtacggcgaggtgggattattaggttggtgcaaaagtaattgtggtttttgccaatacttttaa

SEQ ID NO: 3884 - DNA, 201 bp, Homo sapiens
cccaggctcaagcaattctccagcctcagtcttccatgaagctgggactacaggtgcatgccaccaatgcccagctgatttttgtattttttgtagagacrggttttgccatgttccccaggcaggtctcaaattctggagctcaaagcaatctgcccgcctcagcctcccaatgtgctgggattacaggcatgagccacc

SEQ ID NO: 3885 - DNA, 201 bp, Homo sapiens
catgttgatcaggctggtcttgaactcctgacctcaggtgatccgcctgtcttggcctcccaaaattctgggattacaggcatgagccaccatgcccagcytttttttaaatttccattacttttaatggcaaaaactgcaaattactttcacaccaaattaataggatatttgatgagttttaatataattatcgttttt

SEQ ID NO: 3886 - DNA, 201 bp, Homo sapiens
atttgtttgaaaatgatgggaaactaatgatatagaacataaatatctcttcctttcatagaaagacatatctgaggagggactgaagagggaaggcaggytccaggtacaatctgtcagcactactgctggctgtcctctgcagcctggagctgctttcttgcacagactgtccaataaacttaaacaaacttcaactac

SEQ ID NO: 3887 - DNA, 201 bp, Homo sapiens
gctcaagtgatcctcccacctcaacctcccaaagtgctgggattacaggcataagctactgcacctggcccatacttactattttaattcacttttgagaycatttttgttggtgaaagctaatatttaatctctttattatactacttagtagaagtcttagcaacaaagcaaaacgctacccaactatgtgattttttt

SEQ ID NO: 3888 - DNA, 201 bp, Homo sapiens
tgaaggaggcaaacgtgttcggctaatgcataaaatacagtagatagactctcccagaatatggggttccaaaagaacgttgaggataaggagatctttgktgaccctatgcatttaaacattttaaatggcctttgtccccatcgttagcaggctgagctgttccatcaatggtgggtgggtgggtggtctgactctctg

SEQ ID NO: 3889 - DNA, 201 bp, Homo sapiens
ggatatagggcaagtcacttattccttttgcttccttttttttttttttttttttaaggagtcttgctctgttgcccaggctggagtgcagtggtggtgcratctcggctcactgcaacctccacctcccaggttcaaatgattctcctgcctcagcctcccgcatagctggggttacaggcgtccaccaccacacccggc

SEQ ID NO: 3890 - DNA, 201 bp, Homo sapiens
tgtgattttttttttactagttatcatctttcttctgtgcacattgtgaaaaagtttttttttatgtttcttttaacagcagtcacttttacctaagaaayctttctatctcataaagaaatgcaaaagctattggtgtagcttaatttgccaaaatttttctgaattgatgtttaccaaatttggctgagcagatgtaat

SEQ ID NO: 3891 - DNA, 201 bp, Homo sapiens
tggaagagtatgaaagataaacctagggatttaaaaatatagagactattgtaggcagggggaaattcctaaaaatttctcttatgttttctctgacttcmaatcaacttaaaaatgtaaatgaaaggtttgggttacatttaggaggggttgccaggcagtcaaggagactatgtcttagcaatgatcaacataggcagc

SEQ ID NO: 3892 - DNA, 201 bp, Homo sapiens
gtgtagcttaatttgccaaaatttttctgaattgatgtttaccaaatttggctgagcagatgtaattggaaaccattgaatgctttgtttctcattcccaratttactattgattaatctgtgttctttcttccacatgtgagaggttttgatacaagtgatgactattgttattttaattctgtgagactctcccccaac

SEQ ID NO: 3893 - DNA, 201 bp, Homo sapiens
gctgaataatattgagctccatttggggtttggatttaaacactgatgccttgcctttcagcagaatcgactctgtccagcacatggtagctgatattcakgaattctttttgttcagttccacaataatatgaaccacagtaggctcatttggtgctaatctgagcataataggcaatgttacagccagtcttcattgta

SEQ ID NO: 3894 - DNA, 201 bp, Homo sapiens
gatttccacatttgaataaggttaataaggaagacattaagttaaacctacaagccttagtcggtatcccaaggtgcagctgggagccccaggtttccccyactccatgtccaaagctgtctacttcttttcatcaggaccctgggtccctatacacggagaggagaggagggggagatatcaaagcaagacaggatggct

SEQ ID NO: 3895 - DNA, 201 bp, Homo sapiens
tagtagagatggggtttcaccatgttggccaggctggtctcaaactcctgacctcaagtgatccacccacctcggcctcccaaagtgctgggatcacaggyatgagccaccatgcccagcctactctccctcctttgaaaccttgctgacaaactacctactctataaatcacgctcagatacactaaatcctacttgtca

SEQ ID NO: 3896 - DNA, 201 bp, Homo sapiens
cttggaaaaaagatacaatgtgctaattctccagtggagcgaagatgttgtgtggtacacagatgagagattatccatcaggatgagggggaaggaggccrcttgtcatcaaagtgctagatcctctgaagctcggcttcctcagctgacaactgggatgatgaatttgtttctcttagaatttgtttgaaaatcactgag

SEQ ID NO: 3897 - DNA, 201 bp, Homo sapiens
acactgagaatactccaaaacttgtcttttctctctcttctggctttatgtggaaagtatgtttcctcaccaagacctctatacccttgttctcaaacaamttttaagcctaagaaaacaaattgtgtgttctctggggatgtgagcatcattcatttgcctgaattcccatctaagtttcatcccttcccttctatcaag

SEQ ID NO: 3898 - DNA, 201 bp, Homo sapiens
tcttcccacccctctctgacctcctgtttcattattttccccttcatcccagagttcacatgatcttgtacccactgtagctatcaggtctctgccttgattttttttttttttgcgacagtctcactctgttgcccaggcggctcaatacaacctccacctcctgggttcaagtgattctcctgcctcagcctcccaagt

SEQ ID NO: 3899 - DNA, 201 bp, Homo sapiens
aagatggaaatgtcattagtgagggacagagacaggaaggcaggtggtgttttcggtgagcagaaatgtctggactggagagggtcctaatgggaaatggwaggtcctgtgagtcagcgtcagactccagagagccttgaatgccagccgaggacccgaggatgtcagaactctccaagccctagagatcaccttgtctag

SEQ ID NO: 3900 - DNA, 201 bp, Homo sapiens
gaaattgtttatcttcactggggatgagggaagtaaggcacccaaatgcactcgttctgaggagtttttgctgaatgtattgcagatgagaccagagagamttgtgtagttggagtcaaacccctcttctgagtgtatgtagcatctcaagaatcaagtaggcgacatcctggtggggctctataagtccccacattagag

SEQ ID NO: 3901 - DNA, 201 bp, Homo sapiens
ctcttaaagtattaggcaaagtattatgtcccatctgtggaactgttagagggttactggaaatgctttttgtctggaagttggggttgccataaaacaartctgcggacactacagaaaagacttcagtcctacaatgtgtcctgggatgtggctggattcctgggggaggtttctacccacacagctcctcctttgtct

SEQ ID NO: 3902 - DNA, 201 bp, Homo sapiens
cacctcagcctcccgagtagctgggactacaggcacccaccaccatgcccggctaatttttgtattttttttttttttttttttttttttttagtcgagayggggtttcaccatgttggccaggctggtctcgaactcctaacctcagatgatctgcctgccttgacctcccaaagtgctgggattataggcttgagccac

SEQ ID NO: 3903 - DNA, 201 bp, Homo sapiens
ggaaactgtgggaatatatgagcgtcagaatcaacgtactgcagaaattcaagtgctaaaccacagaaaagccctcttttacaaagtaggaggaagagcaggggggaaaggtgatagggaggatcccttggggtggtaagaagaggaacagaggagttaggagtatcggaggacaggagaggaaagaatttcaagagagaa

SEQ ID NO: 3904 - DNA, 201 bp, Homo sapiens
cggtgagcagaaatgtctggactggagagggtcctaatgggaaatggaaggtcctgtgagtcagcgtcagactccagagagccttgaatgccagccgaggrcccgaggatgtcagaactctccaagccctagagatcaccttgtctagcccttcctttacacacgaggaaactgagactcagaaaacttatccaaggcgac

SEQ ID NO: 3905 - DNA, 201 bp, Homo sapiens
agtcacaagagaggtggtgcagaatcggtggagcaggagatgaagcaagtgggtcgtgaggcacaaggggaagggtaaagttgaagcagcgggtgagggcygggcgtcgcggcacccagcaccgagctggcaaaatgaaggaagaggcaagtttgaaagggaaggcagggagttctgtatgggacctggtgagtttggggt

SEQ ID NO: 3906 - DNA, 201 bp, Homo sapiens
atgttggccaggctggtctcgaactcctaacctcagatgatctgcctgccttgacctcccaaagtgctgggattataggcttgagccaccgcacctggccrgtgtttattttttaagtacacaaggagaactatatccctccattcttcttttggcctggaaaaactgggtaaaacgtaaagctaggatttatgtgcactt

SEQ ID NO: 3907 - DNA, 201 bp, Homo sapiens
agaattagttcccctgaaatgatctaatccatttaaaaagtagtcctccttgttgtattttctctaaagagctaaaaattggaactgtgactgggtatggyggctcacgcctgtaatcccagcactttgggaggccaaggtgggcggatcacctgaggtcaagagttggagaccagcctggctaacatggcgaaaccccat

SEQ ID NO: 3908 - DNA, 201 bp, Homo sapiens
accagctagttctattcagaatggtgcatacaggtctatgggtgccaaccagagtttaaaacaaagggagaaattatttgcctattatctatactattacttttttttttttttttgagtcagagtcttgctctgtcgtccatgctggagtgcagtggtgtgatctcagctcactgcaacctctgcctcccaggttcaagt

SEQ ID NO: 3909 - DNA, 201 bp, Homo sapiens
ggggttggagaaggaaccccttttcccacccaacacaggtgtctctcaggactctgtctcttttttaagaaatgggaatccaaattctaaaataaagttayttcttccctctccttctaggtcttcctggcagaattcaagaaaaccaatcaatttttcgcaataaaggccttaaagaaagatgtggtcttgatggacgat

SEQ ID NO: 3910 - DNA, 201 bp, Homo sapiens
gccctattggatcaagaccttaccccatgacctcatttaacccgaattatctccataaagcccttacctacagttacattgtgggttagggcatcaacatrtgtattttgagaggacgccattcagtccaaagcatgaggctgcactgcaaagcctgggccagcaaaacccactggaaaaaagtgagcacaaggcttagtc

SEQ ID NO: 3911 - DNA, 201 bp, Homo sapiens
catgctggtcttgaactcctgacttcaagtgatccacctgcttgggcctcccaaagtgctaggattacaggcgtgagccaccgtacctggcctatactatracttttaatgtctgtgtatgttttattagcaatagcaaaaacaacaaaaaaaatgacaatgtgagcattattgtttaaaatataagaacaagtactagat

SEQ ID NO: 3912 - DNA, 201 bp, Homo sapiens
ggatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgt

SEQ ID NO: 3913 - DNA, 201 bp, Homo sapiens
gatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgta

SEQ ID NO: 3914 - DNA, 201 bp, Homo sapiens
tagcccttcctttacacacgaggaaactgagactcagaaaacttatccaaggcgacgtgggtagtcagtctctcggatagctgtcgtgttatttccaccgygcagtggctttctaattgggtactttggaaccccaagtttccctagagagtcctcagcagtccccatatggtaagggggagagaggaagttgagactgct

SEQ ID NO: 3915 - DNA, 201 bp, Homo sapiens
agcaagtgggtcgtgaggcacaaggggaagggtaaagttgaagcagcgggtgagggccgggcgtcgcggcacccagcaccgagctggcaaaatgaaggaaraggcaagtttgaaagggaaggcagggagttctgtatgggacctggtgagtttggggtccccttggagatttccaggagagagtcgaatgcgtgactttat

SEQ ID NO: 3916 - DNA, 201 bp, Homo sapiens
agtcctcagcagtccccatatggtaagggggagagaggaagttgagactgctaagaatttgccaatcagatacaccgggtgattgcacaaacatttcaccyggaactttaaaagattctcctacttttttttaaaaaagcgaaaaaacttcactttacaatagcatgttgtttggtctttatatttttttggtagaacgga

SEQ ID NO: 3917 - DNA, 201 bp, Homo sapiens
tggctctttacatcaaaaggcaaatgataggacacaatgacatttagtgtgcagcacctgtaagctgctgaaactggcttggggtctgcatttgcttatcragaaagaatgcctggaagcctggttccctgtccaatcagagttgcaggggtctgggttgtaaatcagagttaggaagagtctcaaacttcgcctgattat

SEQ ID NO: 3918 - DNA, 201 bp, Homo sapiens
attcagatctgactttggcaaaagcctttacgcagagtcaacagcttaactggtccagggccaggtggggaaatcatgagaacattatgatgaacaggacwccggggttttagttagttgacatttctatctgagttggcagtagaatgtaacgtctgcaaaagtcagttcattcatggtctgcatttatggaccttcagt

SEQ ID NO: 3919 - DNA, 201 bp, Homo sapiens
ggctctttacatcaaaaggcaaatgataggacacaatgacatttagtgtgcagcacctgtaagctgctgaaactggcttggggtctgcatttgcttatcargaaagaatgcctggaagcctggttccctgtccaatcagagttgcaggggtctgggttgtaaatcagagttaggaagagtctcaaacttcgcctgattatt

SEQ ID NO: 3920 - DNA, 201 bp, Homo sapiens
gtgtcctaagacacttagtgcctagtagctctagtaactgtttgttgaatgaatgaatgagtgaatggatgcatagtcactaaatcagaaatcgtggataytgtaatcatagaacattaggtcataaataccaaggatcctgaggaagaagaagaaagaatatctatgatttggacagccatttttccaattgtggaacat

SEQ ID NO: 3921 - DNA, 201 bp, Homo sapiens
atgttgttgcaagtagagattttctcctttttcagggctgatactcccctgtgtatatatagcacagtttctgtatccatttatccactgatggacacttrgagtccatatcttggctattgtgaatgaagctgcaatgagcaagcaagtgcagctgtctcctctacatactggttttatttccgttggtaatttacccac

SEQ ID NO: 3922 - DNA, 201 bp, Homo sapiens
ttccaccatgttttctgttttaaagaaccttaggctccttaaaatgccctataactcatggttacttcataaataaacatctagctgatgtaagaataacyggtaactactccagacacccaggggacctgttacttttctaagttaatgtttagactctcctgtttcttaatgcccttgacaggttttatttaagtttga

SEQ ID NO: 3923 - DNA, 201 bp, Homo sapiens
aaccttagaatccatcttagctgatgaaggggcaactgtcttggtctctcagatcacacgtgaatggagagtgaagatgagaccgactgaaatttagagtkcacagaggacagatcacacagcttagtcctgaggcaggctattccagcacatatttttgtctacagaaactctcatttctggttaaacacccagggaaat

SEQ ID NO: 3924 - DNA, 201 bp, Homo sapiens
aagtatctgtaaagtgctcatataacgacatttcctaagggtaattgttaggtgttctttggtttaagggagaaactaactaaatccgtgctttaaaaaakataggtctgtacatttccatttatgtcctcactggcaaaagtcattaagctacatcagcaaaggcagaatgacctggctcacctgcgagacgggccacca

SEQ ID NO: 3925 - DNA, 201 bp, Homo sapiens
gcatctcattcccagggcaagaatagttgttctcaacatctgtcccaagctccagtgatgttccaaggacccaacaggccagcctcaagcactctaattayttgtgacagaaccacatctaatacatgggttagtcatttgtgataaaataaaaattttaccttgtttttagctatcagaactattaaaccatgtctcacc

SEQ ID NO: 3926 - DNA, 201 bp, Homo sapiens
tttccacaattagttggaactatgatttttgtatcctgtatagcttgtgcctttgcaatttattttcttgggtcataaacagtgcctttcttacaaatttrtatacccatattatgtaagaatggcgtttacttacttctgttacactaaccatagctatttccctgggtaggtctttactgttaagtttggttattttct

SEQ ID NO: 3927 - DNA, 201 bp, Homo sapiens
atggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtac

SEQ ID NO: 3928 - DNA, 201 bp, Homo sapiens; identical to SEQ ID NO: 871

SEQ ID NO: 3929 - DNA, 201 bp, Homo sapiens
ggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtacct

SEQ ID NO: 3930 - DNA, 201 bp, Homo sapiens; identical to SEQ ID NO: 873

SEQ ID NO: 3931 - DNA, 201 bp, Homo sapiens
agggtgacaccagaaaaggtcagggtgctttaactctggctttgtgagttagtgatccctctagactcaaacagaattaaggaaatcttcagaaagtcccracagggcaaaaactcccgtaactgaagatgattcttagtgatttttcctgatttgtggagaaatgaagttttgtctaaaagacccaattggcccaggaaa

SEQ ID NO: 3932 - DNA, 201 bp, Homo sapiens
tcacgcctataatcccagcattttgagtctgaggcagaaggattgcttaatgtcaggagttcatgaccagccttggcaacatagtgagaccttgtctctamaaaaaattttaaaaattagccaggcatggcgatggcacacatgtggtcaagagtctgaggtgggaggactgcttgctcaagaggttgaggctgcagtgaa

SEQ ID NO: 3933 - DNA, 201 bp, Homo sapiens; identical to SEQ ID NO: 874

SEQ ID NO: 3934 - DNA, 201 bp, Homo sapiens
gcaaagggcgcctcctaaagacaaatttgtaagtcatctacctgctaattcagcaacgtgacagatacggaacccagcaaatcatgatgtttacccaaccrtctcctttagataaaacttccaaactctgcaggaaattaggacttcattaatatctgtgaaattaatgcctgtcaaaagctcctaatttgtctctcttgt

SEQ ID NO: 3935 - DNA, 201 bp, Homo sapiens
acccagcaaatcatgatgtttacccaaccgtctcctttagataaaacttccaaactctgcaggaaattaggacttcattaatatctgtgaaattaatgccygtcaaaagctcctaatttgtctctcttgtggagtcaaagaacactggtatttagcatactggagatcccttttgtcttagctagatgaggtattacaggc

SEQ ID NO: 3936 - DNA, 201 bp, Homo sapiens
catacatatatttaaagacgtggcgtagggagagcttctaaaacctgcaaagccaaagctgcacagctcctgcaagttagcgatccactctaagtttttcwgttgttgtttctgtcttcttgcctctcatgaacttctgtttctgatttcaagagtaacctgctgggcaccatcagcctttgtttcagtgacctgcgattt

SEQ ID NO: 3937 - DNA, 201 bp, Homo sapiens
gttgtgtggtacacagatgagagattatccatcaggatgagggggaaggaggccgcttgtcatcaaagtgctagatcctctgaagctcggcttcctcagcygacaactgggatgatgaatttgtttctcttagaatttgtttgaaaatcactgaggcatctagcacagtgcctgcctctcaaagaacattggttggagtgg

SEQ ID NO: 3938 - DNA, 201 bp, Homo sapiens
ctatcatttttggacatttgggttggttccaagtctttgctattgtgaatagtgccacaacaaacagatgtgtgcatgtgtctttatagcagcatgatttmtagtcctttgggtatatacccagtaatgggatggctgggtcaaatggtatttctagttctagatccctgaggaatcgccacactgacttccacaatggtt

SEQ ID NO: 3939 - DNA, 201 bp, Homo sapiens
aactgggatgatgaatttgtttctcttagaatttgtttgaaaatcactgaggcatctagcacagtgcctgcctctcaaagaacattggttggagtggatgwtgtatcagtcgtaagaatcatgagtgatgtgaatgatgtatgatagggtgatcaatcctgaatatgacttgaacagaagagagagagctccctgtcaggg

SEQ ID NO: 3940 - DNA, 201 bp, Homo sapiens
tcatttttggacatttgggttggttccaagtctttgctattgtgaatagtgccacaacaaacagatgtgtgcatgtgtctttatagcagcatgatttctartcctttgggtatatacccagtaatgggatggctgggtcaaatggtatttctagttctagatccctgaggaatcgccacactgacttccacaatggttgaa

SEQ ID NO: 3941 - DNA, 201 bp, Homo sapiens
agaaagtttcacaaggaaaagggggtgaaagctgagccctgaaagataaggcagaatttaaagatgaggggagggaagcaggagtcgactaggggagggtrtctcatggcaagatggaaatgtcattagtgagggacagagacaggaaggcaggtggtgttttcggtgagcagaaatgtctggactggagagggtcctaat

SEQ ID NO: 3942 - DNA, 201 bp, Homo sapiens
ttcctatttctccacatcctctccagcatctgttgtttcctgactttttaatgattgccattctaactggtgtgagatggtatctcattgtggttttgaawtgcatttctctgatggccagtgatgatgagcattttttcatgtgtcttttggctgcataaatgtcttcttttgagaagtgtctgttcatatccttcgccc

SEQ ID NO: 3943 - DNA, 201 bp, Homo sapiens
ccagcatctgttgtttcctgactttttaatgattgccattctaactggtgtgagatggtatctcattgtggttttgaattgcatttctctgatggccagtsatgatgagcattttttcatgtgtcttttggctgcataaatgtcttcttttgagaagtgtctgttcatatccttcgcccactttttgatggggttgttttt

SEQ ID NO: 3944 - DNA, 201 bp, Homo sapiens
ctggacgtggtgctataaaagatgattcaggagtggcacaggctgagggggactaggctggagaaggtggagggaagagggagcactccgtgccctcttcytgtccatgggaaatgaaccatctgtgcctggtgtccaagtccttgacgttccagttgccctttgagagcacacctcaagcctgctgaattcttttaagaa

SEQ ID NO: 3945 - DNA, 201 bp, Homo sapiens
catgctgtttgcagcagtcaattgagttgaattagaattccaaccatacattttaaaggtatttgtgctgtgtgtatattttgataaaatgttgtgacttmatggcaaacaggtggatgtgtaaaaatggaataaaaaaaaaaaaagagtcctcttaatcgtttacttccccgcttgccccccacaagaacttgcttctgc

SEQ ID NO: 3946 - DNA, 201 bp, Homo sapiens
tatctgtgaaattaatgcctgtcaaaagctcctaatttgtctctcttgtggagtcaaagaacactggtatttagcatactggagatcccttttgtcttagmtagatgaggtattacaggcccaagatctccaggtatgttactgattctccttccaggtctttattatttcaaatagttttctttctttatacaaaggcag

SEQ ID NO: 3947 - DNA, 201 bp, Homo sapiens
gggggaggaggaggagaatcctgctatgaactgtgtatgaagcaaggtcttccaggacatttgacatcatctggtggaaccaaatcctgccatttaggacrctgatgcccagcaaagccaaggacttcctcatggacacacatttcgtgatggactctaaaccaggacccgatggcccaccggtgctctattgcactgtat

SEQ ID NO: 3948 - DNA, 201 bp, Homo sapiens
gccctatgtggttaagcctggttactttaaataagtctaggtagattaagactgcataatcttccaaccaactctaaagactgcttactgctgctttggcraatcttcagtggatattacaaagcatctataattagccattagaatccaaatttcagaaaacgtacttttgcactcactaaggtcttggctgaatgaaag

SEQ ID NO: 3949 - DNA, 201 bp, Homo sapiens
agcaggtaatgaaggaacaaaaagcagtgtaaagaagagagggactgggggcagggatgtgtgttattttatatagggttgtcctgcaaaggcctgtgagygagggacatttgcagatacaagaagaaactgactcagactttgagaacctcctgccagatgctcagagttcagattctggggttcccaaacctactattt

SEQ ID NO: 3950 - DNA, 201 bp, Homo sapiens
cgttgcataaagtgtatgcacataagggataagcatgatggtagccgatgactggctcagaactcccatgtcaatctgagggtgtgattacactggcctcrggtcaccaggctccctaccacttcctactggtgatttgataatggcgatggttattctttatgggctgtagaacacattgacatcttcagatctctttga

SEQ ID NO: 3951 - DNA, 201 bp, Homo sapiens
tttcattattccatttggaagcaggccccttaccatagctcttccatctccatttttgcctccatctttactccttattcacaagccagagaacaatggtrcatacatgccatgtcaaaagcacttttcttttcattaatctgttgaaactcatatgaaaatttatagttgttgcagcaatgcaagcttattttatcataa

SEQ ID NO: 3952 - DNA, 201 bp, Homo sapiens
attatttctgagggctctgttctgttccattgatctatatctctgttttggtaccagtaccatgctgttttggttactgtagccttgtagtatagtttgargtcaggtagcgtgatgcttccagctttgttcttttggcttaggattgacttggtgatgcgggttcttttttggttccatatgaactttaaagtagttttt

SEQ ID NO: 3953 - DNA, 201 bp, Homo sapiens
cccatggacataatgaccaataatgaccttcaagtcattctttcttattctttttggtctgttaatggcatagtgggatggtttaatagattaacaacagygctcagcttgtcttgaacttggatttgtcctttcttctccttatgtcactttatgggagatcctacatcatcccttaaaatgacactttgttccgccctc

SEQ ID NO: 3954 - DNA, 201 bp, Homo sapiens
gtatagtttgaagtcaggtagcgtgatgcttccagctttgttcttttggcttaggattgacttggtgatgcgggttcttttttggttccatatgaactttraagtagttttttccaattctgtgaagaaagtcatcgatagcttgatggggatggcattgaatctataaattaccttgggcagtatggccattttcacgat

SEQ ID NO: 3955 - DNA, 201 bp, Homo sapiens
ttgtaaaatggcaggcttactgcggatgcttaatctcttttaaaagtgctgtgtctagcgggaagaagagtgacatttactaatatggttgcaaattactkttgaagtttatgcacagctgtttaaaatccctctgagatcagtgccattgtttgatgcaggtgcttaccgcagaaggctcttgttagtcccttcctcctg

SEQ ID NO: 3956 - DNA, 201 bp, Homo sapiens
attcttcctacccatgagcatggaatgttcttccattggtttgtatcctcttttatatcattgagcagtggtttgtagttctccttgaagaggtccttcaygtcccttgtaagttggattcctaggtattttattctctttgaagcaatcgtgaatgggagttcactcaagatttggctctctgtctgttattggtgtcta

SEQ ID NO: 3957 - DNA, 201 bp, Homo sapiens
gtgagacaccatctcaaaaaaaaaaaaagaataaatctttgtaatatttaaaactttttatatctagatccaaattgacactccatctctaaatttttatrtgtcaaaaaaatctaattttaaaaaccaaagttatggaataacctaactagaaaattccttgttgatgacaaggaggagagcattcttttaagaaagctc

SEQ ID NO: 3958 - DNA, 201 bp, Homo sapiens
gaattacacagtattggtctacaaaatttcacttatgttatggagaggtgataaaaatctgttctaagggtgtagctacaggaataaaataaaaggaacartctaaaagaaaatactgttgcagagagatttcatggtagagtagatgaaatatctacagaatgcctgttaagtgtacatagttgaaatgctttataattc

SEQ ID NO: 3959 - DNA, 201 bp, Homo sapiens
gagtggtgagagagggcatccctgtcttgtgccagttttcaaagggaatgcttccagtttttgcccattccgtatgatattggctgtgggtttgtcatagmtagctcttatgattttgagatacatcccatcaatacttaatttattgagagtttttagcatgaagggttgttgaattttgtcaaaggccttttctgcatc

SEQ ID NO: 3960 - DNA, 201 bp, Homo sapiens
tttagcatgaagggttgttgaattttgtcaaaggccttttctgcatctattgagtaatcatgtggtttttgtctttggctctgtttatatgctggattacrtttattgatttgcatatattgaaccagccttgcatcccagggatgaagcccatttgatcatggtggataagctttttaatgtgctgctggattcggtttg

SEQ ID NO: 3961 - DNA, 201 bp, Homo sapiens
ttggtaagctattgattattgccacaatttcagatcctgttattggtctattcagagattcaacttcttcctggtttagtcttgggagagtgtatatgtcraggaatttatccgtttcttctagattttctagtttatttgtgtagaggtgtttgtagtattctctgatggtagtttgtatttctgtgggatcagtggtga

SEQ ID NO: 3962 - DNA, 201 bp, Homo sapiens
atatgtcgaggaatttatccgtttcttctagattttctagtttatttgtgtagaggtgtttgtagtattctctgatggtagtttgtatttctgtgggatcrgtggtgatatcccctttatcattttttattgcgtctatttgattcttctctctttttttctttattagtcttgctagcggtctatcaattttgttgatcc

SEQ ID NO: 3963 - DNA, 201 bp, Homo sapiens
taatttctgttcttttacatttgctgaggagagctttacttccaactatgtggtcaattttggaataggtgtggtgctgaaaaaaatgtatattctgttgmtttggggtggagaattctgtagatgtctattaggtctgcttggtgcagagctgagttcaattcctgggtatccttgttaactttctgtctcattgatctg

SEQ ID NO: 3964 - DNA, 201 bp, Homo sapiens
tgttgacagtggggtgttaaaagtctcccattattattgtgtgggagtctaagtctctttataggtcactcaggacttgctttatgaatctgggtgctccygtattggatgcatatatatttaggatagttagctcttcttgttgaattgatccctttaccattatgtaatggccttgtctcttttgatctttgttggttt

SEQ ID NO: 3965 - DNA, 201 bp, Homo sapiens
tagatgattgcttgggtgctttgagaacatgtagaagggaaccaagtcctgattcggaggttcaggaaaggctttcagaggacaaggtatcgcgggtgggratggaagatgtatgggaattagccaaaaggacaggggttcagaggtgagccaagtctgtcctgaaagtaagcagaaatgttgttgttcttgtcgttttga

SEQ ID NO: 3966 - DNA, 201 bp, Homo sapiens
tattgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaacc

SEQ ID NO: 3967 - DNA, 201 bp, Homo sapiens
tgggattggagggagggagagcgttaggaaaagtagctaatgcatgtggggcttaatacctaggtgatgggatgatgggtgcagcaaaccaccatggcacatgtttacccatgtaacaaacctgcacgtcctgcacctgtatcccagaacttaaaataaaaataaaaattaaagaaaattacatacctatggcatttagtt

SEQ ID NO: 3968 - DNA, 201 bp, Homo sapiens
gggattggagggagggagagcgttaggaaaagtagctaatgcatgtggggcttaatacctaggtgatgggatgatgggtgcagcaaaccaccatggcacatgtttacccatgtaacaaacctgcacgtcctgcacctgtatcccagaacttaaaataaaaataaaaattaaagaaaattacatacctatggcatttagttt

SEQ ID NO: 3969 - DNA, 201 bp, Homo sapiens
atcccagaacttaaaataaaaataaaaattaaagaaaattacatacctatggcatttagttttctataccattcctttaagtcatagaatcagatgagctyaggggctagaaggaagagggagcgatgggaaggcagtcgttggtcatgccctgggcctagatcgcgggaatcagtcattcagaaagccccatatgttggg

SEQ ID NO: 3970 - DNA, 201 bp, Homo sapiens
cttctaactaacctgagcacagaagcaaatatgtaccctttggaaaggaagcagtgaaatggactgcagacctcaagggtggtccccagggatggagcttrtagctgaggcatcttatggaaagcctgatgtggaggcataaagctttagggagcaggaagaggcacttagtccatctgagaacaaagcttctccttccta

SEQ ID NO: 3971 - DNA, 201 bp, Homo sapiens
agggactgtgttcccaaagtttgttagttaggtggctgtttagggaaggaccacacctggttcctgtttgtttgtttcttggtttgtttgttggtttgttwgtttgtttgtttttgaggcagggtcttgttctgttgctcaggttggagtgctgtgactcaatctcggctcactgcaacatctgcctcccaggctcaagca

SEQ ID NO: 3972 - DNA, 201 bp, Homo sapiens
tctcttgggagggttaaatgtggggcatccaacatactataaatctccattgctgttaattaataatcactagtaacgtagtcttcttctcaccctcatgktagtaaacactgactgtgccctgtgatctcttagactttaatggccaattcaacccccccaatgctcaccactagtgtggcgtctgattcagacctgaga

SEQ ID NO: 3973 - DNA, 201 bp, Homo sapiens
cacaacagtcctgtaagttagagaatgcagtagtaattggaaactgaagcccagaggggctaattcatctgcccacatttccacagctaataaatgtctgygaaataaaactagagctagaattttctgtatccaaatgccatgcccttaccattgccaacagtgtgttgctgcatcatttgcaaaaactaaaattgttga

SEQ ID NO: 3974 - DNA, 201 bp, Homo sapiens
tctgcccttattctcagacaataagtactagcctttagtccagtttctcttttaccctatttattagcccactttctggcattaactctacctagcctggytcccatgataagcctttgtcagcactctgctctcattagttcccctttgccatggatagtctgatctccaaaccttgcattctcccctctcattctcccc

SEQ ID NO: 3975 - DNA, 201 bp, Homo sapiens
ataaactttacctctgacatcctcaactcttccttctctctgcagtttcttccttattcccaagacatactgcattatgcatcttccccaatcttgaacaycatctcttcttttttttcacctttttacctccttgagtttttttttctttccctaacacattcctttaaaaagtagtttatatttatcagtttctttttc

SEQ ID NO: 3976 - DNA, 201 bp, Homo sapiens
tcacagctgctcaggaaacttgtaatttgattgactacaaacaagtgataggttagaccacataaatagattagaatccattagtataaaagaaaaaaaaytgcaaaaaccaatgagctcattcaaaccagtaaatagagaaataaatatagtcaatacaaaaaaaattaaagaattctatgtttttacatttattctttt

SEQ ID NO: 3977 - DNA, 201 bp, Homo sapiens
atgtagaaattgtgtatataactatatatttatagtttataaaaatataaactatatgtagacatatatgtatataaacatatatgtatagatatatgtayaaaatatgtttaatatacatataaacatatatgatttttacagtaaaaacctgtatagggtccccataataattcactttcattccctgcatttaaaagt

SEQ ID NO: 3978 - DNA, 201 bp, Homo sapiens
ataaaagaggtgcatgaggaagccaggtctagtcaggaaaaatgcccatgggattttagtttctgcctcaatgggggggctattgggggtaagtgggaagraacagaagtgaaaggtatctttattacaaacagttttccagttttatagtcaaaacttcccccacctaatggcccaaccctgctggtgctactttttcca

SEQ ID NO: 3979 - DNA, 201 bp, Homo sapiens
atgcattttcattcatgcattttaatctctatatgtttggaaaatacaaggatgataaatcagccagttctcatttatttaattatcaaactttttaaaamgcagcttcaaatgaaaaacactctgttaatactcttggcaaatgatacaacagggctgctgatcagaaactgctctgtgatcttagggggttatgagatc

SEQ ID NO: 3980 - DNA, 201 bp, Homo sapiens
attgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaaccc

SEQ ID NO: 3981 - DNA, 201 bp, Homo sapiens
attgaaactgacagctgaagagtgacagagctggttaggtgaagagcaggaggaaggaagctccttacaggctggaagaccctgctgagggagagtccaaygtgttccaggaactgaaatgggaccagtgtggtgacagctgcaagggctgcgcagactggaagcccacactggggaaggcaccaaggcctgggtcatgcg

SEQ ID NO: 3982 - DNA, 201 bp, Homo sapiens
ttgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaacccc

SEQ ID NO: 3983 - DNA, 201 bp, Homo sapiens
gcaggaagcgaagagggcctgagctctggtggagactggtccctggagcttccacagtttaaccggaagggagtagggcaagacagttgctgatggggatrggtgtggagctttggtgatgggcacacaaaggcgcttcccttagactgcatgtgtcccccatggagtttgatggctggaggaaggaaaagagaaagcaac

SEQ ID NO: 3984 - DNA, 201 bp, Homo sapiens
agcctgctcaggagtatgattttctccaacaaaggggcaggttcagagaaggcgaagtggctgggtttttccagagtagaatttctcctaacatttagaascagaaggagataaacttgtgctaaccggtgattctgctaagactcaaagaggttaaagtagtttgttcatgtttgatcacctgtacgtggcagagctggt

SEQ ID NO: 3985 - DNA, 201 bp, Homo sapiens
acatgagatgggtttcctgaatacagcacactgatgggtcttgactctttatccaatttgccagtctgtgtcttttaattggagcatttagtccatttacrtttaaagttaatattgttatgtgtgaatttgatcctgtcattatgatgttagctggttattttgctcgttagttgatgcagtttcttcctagtctcgatg

SEQ ID NO: 3986 - DNA, 201 bp, Homo sapiens
ctttgctatgcaccttcccaaaggaactgttgaattagaaacttctgcagagattataaacctttagaaaataaagcattttatcctgcacaagaatattsacattcttaccaggaatccaactatccaagtgttttgttgttcctgcaataagtttgatttaaactctggaaaactgttttttaaaaaaattccatgtcg

SEQ ID NO: 3987 - DNA, 201 bp, Homo sapiens
ttacgtttaaagttaatattgttatgtgtgaatttgatcctgtcattatgatgttagctggttattttgctcgttagttgatgcagtttcttcctagtctygatggtctttacattttggcatgattttgcagcagctggtaccagttgtgcctttccatgtttagtgcttccttcaggagctcttttagggcaggcctgg

SEQ ID NO: 3988 - DNA, 201 bp, Homo sapiens
agcttagtttggctggatatgaaattgtgggttgaaaattcttttctttaagaatgttgaatattggtccccactgtcttctggcttgtagagtttctgcygagagatcagctgttagtctgacgggcttccctttgtgggtaacccgacctttctctctggctgcccttaacattttttccttcatttcaactttggtga

SEQ ID NO: 3989 - DNA, 201 bp, Homo sapiens
ctcaaatacagtgacttgaccactacacattctgtgtacgtaacaaaataccacatgtgccccataaatatgcaaaatatgatgtatcaataaaaacaaamacacacaaaactcaaagaacaataaaacaaagacggtgaagaggtaaagagaatttctagaacctggcctgtttttagattattaaatgtttcctttttt

SEQ ID NO: 3990 - DNA, 201 bp, Homo sapiens
gtttggctggatatgaaattgtgggttgaaaattcttttctttaagaatgttgaatattggtccccactgtcttctggcttgtagagtttctgccgagagwtcagctgttagtctgacgggcttccctttgtgggtaacccgacctttctctctggctgcccttaacattttttccttcatttcaactttggtgaatctga

SEQ ID NO: 3991 - DNA, 201 bp, Homo sapiens; identical to SEQ ID NO: 865

SEQ ID NO: 3992 - DNA, 201 bp, Homo sapiens
cgggagaatttcttgagcctgggaggtggagattgcagtgagccaagatcatgccattgcactccagcctagcctggcagacagagtgagactctgtctcaaaaaaaaaaaaaaaaaaagatgaattttatgttatgtgctttttaccatgataagaaaagctacataattgcagtttttgtcattacttttaatggcaaa

SEQ ID NO: 3993 - DNA, 201 bp, Homo sapiens
gcttccctttgtgggtaacccgacctttctctctggctgcccttaacattttttccttcatttcaactttggtgaatctgacaattatgtgtcttggagtygctcttctcgaggagtatctttgtggcgttctctgtatttcctgaatctgaatgttggcctgccttgctagattggggaagttctcctggataatatcct

SEQ ID NO: 3994 - DNA, 201 bp, Homo sapiens
tgtgtctttatagcagcatgatttatagtcctttgggtatatacccagtaatgggatggctgggtcaaatggtatttctagttctagatccctgagaaatygccacactgacttccacaatggttgaactagttgacagtcccaccaacagtgtaaaagtgttcctatttctccacatcctctccagcacctgttgtttcc

SEQ ID NO: 3995 - DNA, 201 bp, Homo sapiens
aaacttcccttctcacttcatttcattcatttcatcttccatcactgatactctttcttccagttgatcgcatcagctcctgaggcttctgcattcttcaygtagttctcgagccttggctttcagctccatcagctcctttaagcacttctctctattgcttattctagttatacattcgtctaaatttttttcaaagtt

SEQ ID NO: 3996 - DNA, 201 bp, Homo sapiens
tttagttgaattagatcccatttgtcaattttggcttttgttgccattgcttttggtgttttagacatgaagtccttgcccatgcctatgtcctgaatggyaatgcctaggttttcttctagggtttttatggttttaggtctaacgttgaagtctttaatccatcttgaattaatttttgtataaggtgtaaggaaggga

SEQ ID NO: 3997 - DNA, 201 bp, Homo sapiens
ttcttccagttgatcgcatcagctcctgaggcttctgcattcttcacgtagttctcgagccttggctttcagctccatcagctcctttaagcacttctctstattgcttattctagttatacattcgtctaaatttttttcaaagttttcaacttctttgcctttggtttgaatttcctcctgtagctcggagtagtttga

SEQ ID NO: 3998 - DNA, 201 bp, Homo sapiens
acttaatacttagtcatgtcattttcaattattaaaaataaattcatcacgcctgtaatcccagtactttgggaggctgagatgggcagattgcctgagckcaggaattcaagaccagcctgggcaacatggtaaaaccccatctctactaaaatacaaaaaattagctgggcgtggtggggcgcacctgtagtcccagct

SEQ ID NO: 3999 - DNA, 201 bp, Homo sapiens
agtatactgaaagatagcattttactccaaattttttcccactgacagatttttatctttgtaatgagtttatatatatatatatatatctatatatatakatagatatatgtttctatttaacttttaagtatattctgtaaatatctttgtttcaataagtaataagccactggttataaaatattccattatagttac

SEQ ID NO: 4000 - DNA, 201 bp, Homo sapiens
aacactgagccatctcccactaaattatagtaatacaaatgctgtccaaacattttattaaatgaagaagtttgctatttcttatttcatttgctactgargaagagaatgcttgatatttttttcaattgatgagagtatattatacttctattgctttctatttatatggaatttgtccccatcaggttcagttatgtg

SEQ ID NO: 4001 - DNA, 201 bp, Homo sapiens
atgtaagaggcattactgcttcatttaacctccaaaagcctttataaattagatattattattattccagtttttcagatgaggaaactgaggctcaaggrgtagagccccttgtccaggtcttataaccagtcagtggtagagtcaggttagttggaccatccagattagtctaaccatcaagcatttgctttaaaccgc

SEQ ID NO: 4002 - DNA, 201 bp, Homo sapiens
tgattcgaatattttgtagctgttttgaggggtccttttcgcatccagaccaggatttcacctggacagctggagtgggaaagaagtggatacatttcaarctcctagggctgtagttaatgtgtcctgtcataaccactgcagaacagtgtaggtcagagaatgcaaccactggtggcatgtataacccttcaccaataa

SEQ ID NO: 4003 - DNA, 201 bp, Homo sapiens
gtgctatctcaagacacccagccatgctgctaagaaggcgcattataaagaagcatcaaacattctgcagtttcaaaaagtgaaacgtatatttgcttgartgttcatctaaacactacccataggaaaattcaaacgaaactccagggaattttaatccacatgccacattttcttagtcttttgcaagatagagtcaga

SEQ ID NO: 4004 - DNA, 201 bp, Homo sapiens
gccttggcttggcggttttggtcttcagagcatccctagggccctctcataaggttgcagtcagacctgagatgaggtcactcccttatatggcccctggrtggatgcagctaggaggttgagattcccccaccccgtcttcctccatatgtggccccaaagtaggaagttcctgctgctttggtctttgggtgaaaaaca

SEQ ID NO: 4005 - DNA, 201 bp, Homo sapiens
ttagacccctcaacttcaactttaaaatcttatttctcttcctgcatcacggtgaccacctcctcacaagtgcaagaatagatgacgatattccagcatgytgtgattctcctaaaaacctgctgctcctagggactctgtggagtgagtttcctggaccgaagtcacttctcagatcttcatgttacacccatgatgttt

SEQ ID NO: 4006 - DNA, 201 bp, Homo sapiens
gctgacacatggtcctgcacagaaattctgtaacattagcttgagcatccatccctaaaccattgctgtgaactccaagtgcccagtaagaggctggcccrgttgtgaccgtcattgcctgttttctggtctttcctccaaggccaggatcgcagcagagcctaacctgccattcattattgatggagtttctcagaccta

SEQ ID NO: 4007 - DNA, 201 bp, Homo sapiens
gagctggtcccagcagcgccgcggcacagcttagaacttcccaggggttcctgggcgttatttcatggctcttctgcctgcttcgtttcatttctttcctygaatactctttcctttccgctccattctgttccccgctctctcctaccacctacatttcaagtgctcccctcccctttttcttttgtcccctctcctctc

SEQ ID NO: 4008 - DNA, 201 bp, Homo sapiens
taaaactccatccctctatgttcaatcctagctgacaacctcacttggtgtcacggtgatgcataagaaaatggagctggggctaccgaagttgaaacctracaccttctaaatagggcgaatgtgagttatgcgagttttgccgacaatgtggaatttggagcacaatcatgaaaaaaaaaaatcctttctatagtaaag

SEQ ID NO: 4009 - DNA, 201 bp, Homo sapiens
cagtacagtggcatcgcagaaggacaggtgggaggggaagggataggctgcatcagctgcctttgaaaacgccatcgagcaatagtattgcagccatttayaccataatatttcctacagaggacctcgtttagtttccgagattgagcctctagtctcgctcttcacaccgctgaagatgtgcggtagaggatcttgctg

SEQ ID NO: 4010 - DNA, 201 bp, Homo sapiens
cagttgatcgcatcagctcctgaggcttctgcattcttcacgtagttctcgagccttggctttcagctccatcagctcctttaagcacttctctctattgsttattctagttatacattcgtctaaatttttttcaaagttttcaacttctttgcctttggtttgaatttcctcctgtagctcggagtagtttgatcatct

SEQ ID NO: 4011 - DNA, 201 bp, Homo sapiens
attctgtcccatattgtctctgattgtttatgtgctacttttgtcttcccaacagaattctatatcccagagaacagagggagcaggtgctactgttgagytgaactgaattattttccaggcctggctgaaggaataatgagaccttacgtttctgttcctagagaacgggcagatgtatatccagaaaaagcctaccat

SEQ ID NO: 4012 - DNA, 201 bp, Homo sapiens
tctagttatacattcgtctaaatttttttcaaagttttcaacttctttgcctttggtttgaatttcctcctgtagctcggagtagtttgatcatctgaagmcttcttctctcaactcgtcaaagtcattctccatccagctttgttccgttgctggtgaggaactgcgttcctttggaggaggagaggcactctgcttttt

SEQ ID NO: 4013 - DNA, 201 bp, Homo sapiens
ttttaaaaatcttggttttggccaggtgcagtggctcacacctgtaatcccagcactttggtaggctgaggcgggtggatcatgaggtcaggagatcaagmccatagtggctaacacggtgaaaccccgtctctactaaaatataaaaaattagctgggtgtggtggcacgtacctgtaatcccagctgctcaggaggctg

SEQ ID NO: 4014 - DNA, 201 bp, Homo sapiens
tttagtagagacagggtttcaccatgttggccaggatggtctcgatctcttaacctcatgatccgcccgccttggcctcccaaagtgctgggattacaggygtgagccactgcgcccagccggaaacatcatactttctatggcacactagacactcagtaaatccagatgggattgcaatgcatggaagcagctccctgg

SEQ ID NO: 4015 - DNA, 201 bp, Homo sapiens
tcaggagaagagtgactgatctcagctggcccttcttctgtacctgggaagatgagcttgaaatcaacattgtcagttgagttcctaaaacagaactcagttttagaagttaagcttaggttgcagtcctagggttgcaatcggcataggcttgttttgtaggggaatgtggatcctgaaggatttaggggccagaaagga

SEQ ID NO: 4016 - DNA, 201 bp, Homo sapiens
aagtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtgg

SEQ ID NO: 4017 - DNA, 201 bp, Homo sapiens
acttcaataattttaaagtcattagttgttgggactctgaaaatgtaggaatcctgttatgcatgacagatttccacggtgggcaacagtcacctagcacrtgcctggtagttcagctgtaatgtgggctaaaagctgatggaaagcctaacccctttttaaacagtatttctatgactggctgaactccgtggtggatgg

SEQ ID NO: 4018 - DNA, 201 bp, Homo sapiens
agtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtggt

SEQ ID NO: 4019 - DNA, 201 bp, Homo sapiens
acaaatgagatcacacttaaagctgaaaatagtgagcctctaagagtaaagatcctttgtaattttaaagtacataggggccgggcgcgatggctcactcytgtaatcccggcactttgggaggccaaggcggatggatcacctgaggtcaggagttcaagaccagcctagccagcatggtgaaacccagtctctactaaa

SEQ ID NO: 4020 - DNA, 201 bp, Homo sapiens
aatcgcttgaacccaggaggcaaaggttgcagtgagccaagatcgtgccattgcactccagcctgggcaacagggcgagactccgtctcaaaaaaataaataaataaataaataaataaataaataaataaataacataacataacatcacataacataacatagtacatatcatgatggtgttttgcagctggggtagca

SEQ ID NO: 4021 - DNA, 201 bp, Homo sapiens
cctaacagatagactcagaccccgctatcgagctgtaggtagctcttagagatctttcatttctagatttgagtgctttggggttttttttgtttttgagwtggagtttctctcttgttgcccaagctggagtgcattggcatgatcttggctcactgcaaccactgcctcccaggttcaagcgattctcctgcctcagct

SEQ ID NO: 4022 - DNA, 201 bp, Homo sapiens
cttttcttttcttttctttttttaagacagagtcttgctctgttgcctaggctggagtgcaatgacatgatcttggctctctgcaacctctgcagggagcmaagcgattcccctgcctcagcctccagagtcgctgggattacaggtgccccccaccatgcctggctaattgctgtatttttgtagagagggggtttcacc

SEQ ID NO: 4023 - DNA, 201 bp, Homo sapiens
agtttctctcttgttgcccaagctggagtgcattggcatgatcttggctcactgcaaccactgcctcccaggttcaagcgattctcctgcctcagcttccrgagtagctaggattacaagcacccaccaccacacctggttaatttttgtagttttagtagagatagggtttcaccacgttggccaggctggtctcaaact

SEQ ID NO: 4024 - DNA, 201 bp, Homo sapiens
tgtataagaccttaccaataggaataacacttgataaataatattgtaatactctggtgatccagtctgatgcagtatccctaaatctgggaaaggttgtaaaaaaaaaaaaaaaaaaaaaaaaaaaaaaaaaagatgctatcttaaagatgcatttttttctggcatgtagaagttggaaacagactaaatatgtagcta

SEQ ID NO: 4025 - DNA, 201 bp, Homo sapiens
taaaaatcttggttttggccaggtgcagtggctcacacctgtaatcccagcactttggtaggctgaggcgggtggatcatgaggtcaggagatcaagcccrtagtggctaacacggtgaaaccccgtctctactaaaatataaaaaattagctgggtgtggtggcacgtacctgtaatcccagctgctcaggaggctgagg

SEQ ID NO: 4026 - DNA, 201 bp, Homo sapiens
agccaagcgggaagggggaagccccttatgaaactatactctcactatcataagaacagcatggggggaaaccgcccccatgattcaatcacctcccatcragtccctcccgtgacacatggggattataggattataattcaagatgagattctgggtggggacacaaagccaaaccatatcagccagtacagttgacct

SEQ ID NO: 4027 - DNA, 201 bp, Homo sapiens
aaacgtctgagtttttcaaagccgcctttgacttaatgggtctcctggatccagttctctttaccatctcaggtctccctgacatttgcttcctgagggcttttttttttttttttttgcatttggccttgcctttgaacttggtctaatgagccatgtggatcgagagtccttgtcagaaaagaaggaaactggttttcc

SEQ ID NO: 4028 - DNA, 201 bp, Homo sapiens
aacgtctgagtttttcaaagccgcctttgacttaatgggtctcctggatccagttctctttaccatctcaggtctccctgacatttgcttcctgagggcttttttttttttttttttgcatttggccttgcctttgaacttggtctaatgagccatgtggatcgagagtccttgtcagaaaagaaggaaactggttttcct

SEQ ID NO: 4029 - DNA, 201 bp, Homo sapiens
acctaaataatagtatcaatgatgtttaattccttgaataagagaaatacattcctcccattagtttaaatcatgacccaatgtaaattgaaaaagggtcytgtctgggcatggtggctcatgcctgtaattccagtactttgggaggccgaggtgggcagatcacttgagctcaggagttccagaccaggctaggcaaca

SEQ ID NO: 4030 - DNA, 201 bp, Homo sapiens
gaattcactgaacatgaggaagtgatgagaagtggtgaggaatgggttggggagatattctcggcattgccatttatttagaacagggtttctcagcctcmgcactattggttttgggggggtgcttgggggactagcctgtcatcgtaggttgttgagctgtatctctgacctcaccctactagataccagaagcacacc

SEQ ID NO: 4031 - DNA, 201 bp, Homo sapiens
tgtttctagttttattattattaaactgtgctgcaatgaacagtcttgtaagtatattttcttacactttccttatcactttaaagtcatttaatacacayttccttctataaagcttgtagaggtctcttatccaaattgctatggcgagatctgcttcataattcatattttataaaggtaataaagttacatgctgta

SEQ ID NO: 4032 - DNA, 201 bp, Homo sapiens
tgtttactaagccttttttaaaaaaaacaaaatagtactgtatgtctgtttacatctttagtagtgtgtaagggaagattgttttctttagagttcttttraacaatttcaaggctattcagaaggatccattttaagaaaccaaaacatctttttaaaatgccttgtttaatatatatctttagccataatggaatcccc

SEQ ID NO: 4033 - DNA, 201 bp, Homo sapiens
agatagatccacagagtgctggctggaggaatccatatggcagagggcagagaagcgaatggaaggggaggaagcaaagatggttcaggaagctggttggygaaggaagggaggtaaggccatagcagcgggagaagccacggcagaagttgttagaggttgcaaaaccggagggtgtttataagcgggagtgggagacag

SEQ ID NO: 4034 - DNA, 201 bp, Homo sapiens
ggagtatattacatgatactgaggtttagggtgcgattgatcccatcacccaggaactgagcatagtacccaatagttagtttttcaaccctagacccccyccctcccacctttacttgtccccggtatctatcgttgccatctttatgtccatgagtacccaatatttagctcccacttctaagtgagaatatgcattat

SEQ ID NO: 4035 - DNA, 201 bp, Homo sapiens
cccaaacatatctcccctaattcagttccaaccacactttaattcccagtttggacccccatttttctcctgaaactactgctggagagttctctctcttyggagttgcagttccttctgcaacgttgcatggactttggtaccaactggccttggttgctttgtatatgagtcctgtatcccaaggagactataatcttc

SEQ ID NO: 4036 - DNA, 201 bp, Homo sapiens
ctctctcaccactcctattcaacatagtgttggaagttctggccagggcaattaggcaggagaaggaaataaagggtattcaattaggaaaagaggaagtyaaattgtccctgtttgcagacgacatgactgtatatctagaaaactccatcgtctcagcccaaaatctccttaagctggtaagcaacttcagcaaagtct

SEQ ID NO: 4037 - DNA, 201 bp, Homo sapiens
gtcagttcattcatggtctgcatttatggaccttcagtgcatctagaacttttaccttctgcttatcaaatagtatctggaaatactgattattctggatmtgcattgtaatgatattgacactcatgaaaagatgctcaacacccttcctcagtagggaaatacaacacaaatcaataagctctgcttcacacccattag

SEQ ID NO: 4038 - DNA, 201 bp, Homo sapiens
ttaccttctgcttatcaaatagtatctggaaatactgattattctggatatgcattgtaatgatattgacactcatgaaaagatgctcaacacccttcctyagtagggaaatacaacacaaatcaataagctctgcttcacacccattaggatggctattaccaaaaaaagggaaggtggtgttggtgaggctgtgaagat

SEQ ID NO: 4039 - DNA, 201 bp, Homo sapiens
gaaaatatagtgaggcagaatgttagggccaacagaaaggaaagtagggctctagggattacagtcaccaaggtttctacccttgtgcaagagaaccatcrcttaatacttagtcatgtcattttcaattattaaaaataaattcatcacgcctgtaatcccagtactttgggaggctgagatgggcagattgcctgagct

SEQ ID NO: 4040 - DNA, 201 bp, Homo sapiens
tgggctgcccggaccttcaaatgccctcacaggtgatcatgtttcacacattccattctcctcatcctcctcattccacggacacacacaaacctccccaygcacatctgcttccccagggtcccccttacttcctactgtccccaagggtgacctagaaccaggggtagggcctgactccactgctcagtaggaaggaag

SEQ ID NO: 4041 - DNA, 201 bp, Homo sapiens
ttaaatattttgccacatattttgcaattatgtctcccagctttacgtgtattaataacacacaagttttatgtaaaatagtttggaaatgtttacctttktggggcttgtctgtgggatcatatctaagaagtcattcctaattccaagagggcataattattgatctatgttacctagtacttttagtggtttagcagt

SEQ ID NO: 4042 - DNA, 201 bp, Homo sapiens
tttgtcatccaggctcgctgcttaagagatactgaacagatcttcagagaaggtccggttgaaattggtctcccatgctccatcaaaaatgaagcaaggcygccatgtttaccgacaccgggaaaaagaggtagctgtcctgatcagcagtctaatcactgtcagtcattaatctcaattaaccctaacctaatgcccttg

SEQ ID NO: 4043 - DNA, 201 bp, Homo sapiens
tatgacaatttggggtacatttgtatgggtatgtgaagagctccagaaggaaatttgccacttttttcccttgtgtggaaaattttacagagataaccttmtacagtttgcctagttgcctgaagtacggctctgaggcaggaatagaataattggagaaaggtacaataatttgtacataactatgaacgtgatacttat

SEQ ID NO: 4044 - DNA, 201 bp, Homo sapiens
tttaagtcacagtctcagtaatttttaagattttatgtctttcctttatatgtgtatggtgtatgagattaataaatttattaagaataatgaattcactytttaattgcttcccagataccccagaacattagatgttgtattagaggaacacttaaaggaaattgcagatctgaaaaaacaagagcttttccatcagtt

SEQ ID NO: 4045 - DNA, 201 bp, Homo sapiens
aagtacttcctgttctataaagatatgattcacaagtcacatcttaatatactgaattgtacagagactgtcctttttaaatttgttcttcaagaaggggygagtatcggaatcaaaaatatttgaaatataagaggaaatagtggttgtgtgggggctatggagagtataattttttatagagagactattttgttattg

SEQ ID NO: 4046 - DNA, 201 bp, Homo sapiens
atttcatatagttcacaggaagaaatggattctaataaagtgtctttgcttaatgaacaatttcttccactcattaggcttttagaaagcaagtaagttaygtgtgtatgtttatgctcttctaaagtacttcctgttctataaagatatgattcacaagtcacatcttaatatactgaattgtacagagactgtcctttt

SEQ ID NO: 4047 - DNA, 201 bp, Homo sapiens
acattcactctgcccatagcatcaaaattattcttcctctaatctaccttggatcttgctgctccctaggcactcttattgcaggtagccaaactccactyacctactaaagttcacttaaaattctcctttcatttatttaatcagtatttatggagcatctattacataccatgtacaacgctagatggtgggaatagt

SEQ ID NO: 4048 - DNA, 201 bp, Homo sapiens
atcttcattcttcttgaggcacaacccaaatcctgtgtgatttgtgcagccttcccaggcagtctaagcagacttgctatcagtgtcacatatttggcatstgccattactgcctcctgttatcttttcacacatgtattgtttcttttgtttgtttgagacagagttttgctcttgttgcccaggctagagtgcaatggc

SEQ ID NO: 4049 - DNA, 201 bp, Homo sapiens
aaagtactgggattacaggcgtgagccagcaccatttaaaatagcaatgtagtcttactatgttgttcagacaggtctcgaactcctgaccttaagcagtyctcctgccccggcctccgaaagtgctgggattataatgccagtggtgtgaaccactacaccaggcctctagtttctttatctgtaaaataagtattaaac

SEQ ID NO: 4050 - DNA, 201 bp, Homo sapiens; identical to SEQ ID NO: 916

SEQ ID NO: 4051 - DNA, 201 bp, Homo sapiens
gggcaacagagtgagaccctgtctcttaaagaaataataataaaaataattaatcttcaaacagaaagatgcagccttcccgtttatcttcagatgcactrctttgcagtgttaatcgtcctccattcttccttccttttgtctagtatagtcaaaaagcagtgggtgaaggttcttggcagaggggcccacccagttagg

SEQ ID NO: 4052 - DNA, 201 bp, Homo sapiens; identical to SEQ ID NO: 918

SEQ ID NO: 4053 - DNA, 201 bp, Homo sapiens
gtggtggcatgcacctgtaacaccagcactttgggaggctgaggtgggattatttgaggccaggagtttgagaacagcccggtcaacatagcaaaaccccrtctctacaaaaatttttaaaaagtggtggtggggtcctgggatgtcccagcttcttcggaggctggggcaggaggatctctttgagctcaggagatccag

SEQ ID NO: 4054 - DNA, 201 bp, Homo sapiens
taccgttctaatgacgtcttctttaaaaattaggtagttgagagtggtggtcctgagattttaaaaggccttgaagagaggtatgtttccttttctttttytactttttatttggaaatgacttcaaacttatagaaaacctggaaaaacagtacagaaaattcatatactctttacaaccaggttcaccatttgataata

SEQ ID NO: 4055 - DNA, 201 bp, Homo sapiens
aaaaaaaaaaaaaatcgataaaggccaggcgaggtggcttacacctatagtctcagcactttgggaggctaaggcaggaggatcacttgaggccaagagtwcaagaccagcttggacaacgtgatgagatcctgcctctacaaaaaatacaaaaattagctgggcgtgatggtgcgtgcctgtagtcccagctactcagtt

SEQ ID NO: 4056 - DNA, 201 bp, Homo sapiens
gattaaattgtaatgtcagaaaacagttgctgtggaaggtttcagtgaatggtccgagtttcattgaactgacttgaaatgacttttattattgacttccmtaccgttctaatgacgtcttctttaaaaattaggtagttgagagtggtggtcctgagattttaaaaggccttgaagagaggtatgtttccttttcttttt

SEQ ID NO: 4057 - DNA, 201 bp, Homo sapiens
acaaaaatttttaaaaagtggtggtggggtcctgggatgtcccagcttcttcggaggctggggcaggaggatctctttgagctcaggagatccaggctgcrgtgagatatgatcacatcactgcacttcagcctgggccatggagaaagaccctgtctctaaaaaaataaataaaattcttctggcaatttcttggggccc

SEQ ID NO: 4058 - DNA, 201 bp, Homo sapiens
tgtatttttctgaaccattgtagtactttttagatactaccagtagaatgtaattaaaataaattaagagaaatagagttactacagtataatgaagatgmtatgaacctgattaaattgtaatgtcagaaaacagttgctgtggaaggtttcagtgaatggtccgagtttcattgaactgacttgaaatgacttttatta

SEQ ID NO: 4059 - DNA, 201 bp, Homo sapiens
accagctcagcatgtcatagaattcggtagtgctaattgagtgttgattgctgtatttttctgaaccattgtagtactttttagatactaccagtagaatrtaattaaaataaattaagagaaatagagttactacagtataatgaagatgatatgaacctgattaaattgtaatgtcagaaaacagttgctgtggaaggt

SEQ ID NO: 4060 - DNA, 201 bp, Homo sapiens
cccagcttcttcggaggctggggcaggaggatctctttgagctcaggagatccaggctgcggtgagatatgatcacatcactgcacttcagcctgggccayggagaaagaccctgtctctaaaaaaataaataaaattcttctggcaatttcttggggcccatctaaaagccttatcttgttcacctaaacttgttttgtg

SEQ ID NO: 4061 - DNA, 201 bp, Homo sapiens
ttaatgtacaatgtcatttagcctccagtaagcaggaaatgtgattaaatgtgatacccatcaaattggcaaaactgttgaagtcgttagtaccagggatkgggtacgtagtggcagacagtgtgattgttccaaccactttagaaagcaattggcaggatcccatgaggttgaaagttccagtaattcctgtgatctggt

SEQ ID NO: 4062 - DNA, 201 bp, Homo sapiens
cagggtctcgctctattacccaggctgatgtcaaattcctggcctcaagcgatcctcccaactcgagttcccatagtgctgggattacaggcatgagccaycatgcccagcctttctttacctggatatagtgagttctgcatgtatgatttgtatacatctctgtttgtgtattaaacttgtttaaacaatgagagaaaa

SEQ ID NO: 4063 - DNA, 201 bp, Homo sapiens
ggttcagatatatggctgcttattagctcttgaggatttgtttaaatgatggggtcttgctatgttatccaggctggcctcaaactcctgggcttaagcartcctcccacctcagcctccagagtagctgggattatagacatgcaccactgtgcctgactaacttaatttttgtgaattctgtgaattttcatttttctc

SEQ ID NO: 4064 - DNA, 201 bp, Homo sapiens
gaagatgtccttggtttttttttgttttgtttcttgttgttttttttttaattccaaaattactctttgtaaatgttctgtgaaagcaagttagatgatcrtatacttttccctgaacaattcctcagtgtttattttttgttagttctttgaaagagcacataattacatttgtaaccaaattttgttacatttaaagta

SEQ ID NO: 4065 - DNA, 201 bp, Homo sapiens
ggtcaaggctgcagtgagctgtgattgcaccactgcactccaaactgggcaacagagcaagaccctgtctcaaaaaaaaaaaaaaaagggctgtacatctrtacatatttctggtcacttctaagtattgcttttaagttactggcactagcaaaatctcaccaaacacaaaagtttaataatagaaatggcaggtgatta

SEQ ID NO: 4066 - DNA, 201 bp, Homo sapiens
ttcaggtttttgctgagtacccgggcagctcagctcagttgagggtgctcttggctttctatgcttctaccatagtgtcggcgctggtagctgcagaggaygtatcagacaatatcatcgccaaactatttccctatatccaaaaggttggcactgctgatgtgttaagtagattattttgtacttaaaggaattttcttg

SEQ ID NO: 4067 - DNA, 201 bp, Homo sapiens
aaactatgtcatttaaagaaatcatgtcccttttatgaaaaatatcatttaaacatttgtaaagagattgaagctattttcatattgaggatttgagtcaragctccttaacctggggttctccatgagctttaggggatcttaatctactgaaatcatatgcaaagttttatctgtatgggatttctttttttcttgtaa

SEQ ID NO: 4068 - DNA, 201 bp, Homo sapiens
tggctgcggatgggggcggcatatcgagggagggtaagagttttccggatatctgcggaatcagggttgaaggaaagccttggcgcggtcgccgctactgkaattagttgttaacgctgctgccatcgtctttgcatctccggggtccacaaatctcaggacacccgcgttgtgtgtccatgacggtgctgagtgcagaag

SEQ ID NO: 4069 - DNA, 201 bp, Homo sapiens
ccaaagatttagttgtgatgttagaaccttataaaaagagatatctggatcccaccccatatctaaagaatctctggggcagtaaatctgtttttgtgcawgtgtgtatatgtcttattccttcctagctgattagaatatacatatctgatccggcacttggaaacaatcggtatggatgattctgtattgcattactag

SEQ ID NO: 4070 - DNA, 201 bp, Homo sapiens
ccttagcccagcagctgcaacgactcgccctccctcaaagtgatgccagcctcttatctagagatgaagttgcttctttgttatttgaccctaaggaagcrgccacaatcgacagggacaccgccttcgccattggtgagccatcttttaacttagaaaagctcttggaagcgtttgttttctggatgttactgttttttt

SEQ ID NO: 4071 - DNA, 201 bp, Homo sapiens
aagtaaaaaaaaaaataattccttggtattatctaatacctagttcataatcatatttccatggttatcacaaaagtattttttatagttgttttctttgwatcagaatccaaagatttagttgtgatgttagaaccttataaaaagagatatctggatcccaccccatatctaaagaatctctggggcagtaaatctgtt

SEQ ID NO: 4072 - DNA, 201 bp, Homo sapiens
cttttggcatttgcattcacttctcctttaacgacgacagttcgtccagggcccatgggggtgttcaaccttgcagcgaatggcagcctctgaaaagaagscacagtcaggaccaagaggcctgcagaaagcgatctccagggaaaactcgtgtccaaagaacactacggaatgtttcagagccatgaccctgtaaatccc

SEQ ID NO: 4073 - DNA, 201 bp, Homo sapiens
taataaataaataaaaagatactgtgggttatttgggttatgacagtttataatgtaaacaaaagtagacttgtaaacagtgaagagtatataatagcacrggccctgtaaaagagtacaatcacaatactaatcggtaggttgaatagaaactaacattgctacactcctactaatatgttaggcccattactatattta

SEQ ID NO: 4074 - DNA, 201 bp, Homo sapiens
gcggagatcgctccactgcactccagcctgggcgacagagcgagactccatctcaaaaaaaataataaataaataaaaagatactgtgggttatttgggtwatgacagtttataatgtaaacaaaagtagacttgtaaacagtgaagagtatataatagcacgggccctgtaaaagagtacaatcacaatactaatcggta

SEQ ID NO: 4075 - DNA, 201 bp, Homo sapiens
acagtcaggaccaagaggcctgcagaaagcgatctccagggaaaactcgtgtccaaagaacactacggaatgtttcagagccatgaccctgtaaatcccasgaggggagagacagtctgccttggtcccagctgggtcccctgcagcagcactgtccctggctcgaagcaaacacacatgattacattttagacgatgaaa

SEQ ID NO: 4076 - DNA, 201 bp, Homo sapiens
ttcttgtattttccttgaaaaaatttatttatgcactgaaagctcctaaatcttttcctaaaggtaagatacaagctgtgaatcttttaaatgtgatactstgcaaaactgaatgattgactccacaatgactgtcttgaataaaaagctcccagcatgttcatgtaggatctagcatcatttctctttccatgtccttgt

SEQ ID NO: 4077 - DNA, 201 bp, Homo sapiens
tcagaacccttagtttgtactagtttttgtttcctttaacatttcaggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatg

SEQ ID NO: 4078 - DNA, 201 bp, Homo sapiens
aacacataatacctagatagacctgagttgaaaaaattgttttatgaaaatcaagagcaactggtaatagagtgtgtttatttttcaaggtggaggatttrataagcgtgggtgaggaggagtcctttaacctgaagcagaaagtaacgtttcatgtgatcctgtctgtgctcgtctcttgttgttcatctttaaaagaaa

SEQ ID NO: 4079 - DNA, 201 bp, Homo sapiens
ccaccatgcccagctaattttgtatatttagtagagacaaggtttcaccatgttggtcaggctgatctcgaactcctgtcctcaggtgatccgcccacctyggcctcccaaagtactgggattacaggcgtgagccagcaccatttaaaatagcaatgtagtcttactatgttgttcagacaggtctcgaactcctgacct

SEQ ID NO: 4080 - DNA, 201 bp, Homo sapiens
tacttagaaatcagtgcttagtactttataaaggctttctgtttgtcatctcactttaaatgtaaaacacataatacctagatagacctgagttgaaaaarttgttttatgaaaatcaagagcaactggtaatagagtgtgtttatttttcaaggtggaggatttaataagcgtgggtgaggaggagtcctttaacctgaa

SEQ ID NO: 4081 - DNA, 201 bp, Homo sapiens
ggattacaggcatgtgccaccatgcccagctaattttgtatatttagtagagacaaggtttcaccatgttggtcaggctgatctcgaactcctgtcctcakgtgatccgcccaccttggcctcccaaagtactgggattacaggcgtgagccagcaccatttaaaatagcaatgtagtcttactatgttgttcagacaggt

SEQ ID NO: 4082 - DNA, 201 bp, Homo sapiens
tgtgtttatttttcaaggtggaggatttaataagcgtgggtgaggaggagtcctttaacctgaagcagaaagtaacgtttcatgtgatcctgtctgtgctygtctcttgttgttcatctttaaaagaaacccactttccatttgcgataagagtcttcagtttgttgcagaaaaaaataaagaagcttgaaagtgtcatta

SEQ ID NO: 4083 - DNA, 201 bp, Homo sapiens
cattaaccagttggcaagtgcaattatgttcattacagtttctgaaattattcttataattacttagaaatcagtgcttagtactttataaaggctttctrtttgtcatctcactttaaatgtaaaacacataatacctagatagacctgagttgaaaaaattgttttatgaaaatcaagagcaactggtaatagagtgtg

SEQ ID NO: 4084 - DNA, 201 bp, Homo sapiens
tttaatgtatatcttgttttgtctgtatcatttcattaactataagtacttaatccagtaactggcagcattaaaagcaaaagtaatttttcttgcatgtstttagtgcttatagatgaaaatggaaagttagtggttaagacaaatttgggtaataactaaatgcagtttgtggccgtttgaagttttctcttagtaaat

SEQ ID NO: 4085 - DNA, 201 bp, Homo sapiens
agaccatttgttggctaggtaagctattatttttgacatgcttttgatttacatttttgtgactcagtataattttcaagattggttagaaatttcccagyattcctttttaatgtatatcttgttttgtctgtatcatttcattaactataagtacttaatccagtaactggcagcattaaaagcaaaagtaatttttct

SEQ ID NO: 4086 - DNA, 201 bp, Homo sapiens
gtgatctatacaaaagagctttaaaaaatataaatgactaaataagtggaatgcacttgtgcaaatagataaaaagctggatatcagtgtgtgtgttttaytctgagaacgattttctgctataagtgaatttaataatgttagcttgcaaaataaatttttcccaacacaattttaatttttacatattaaggagaagaa

SEQ ID NO: 4087 - DNA, 201 bp, Homo sapiens
agtctctacatgaaaaagactggaatacttttaaaatttattactgagtaaacctttgccttctcatttaggtatttaatgaactttagtgattcatttayaatgaatatctcatccagttgccaaaaaagttttttccctagagtaattaaaaatataagaccaagaaaatttttatacataaaaatccaaattatgaaa

SEQ ID NO: 4088 - DNA, 201 bp, Homo sapiens
ttgcttcttcaaaggccattccctcacttatgtaatgttcctgatcttattacaatacttcatgggatttctgaaacttacgatgtcagtcctcttctgcrttacatgcttccccatctggtcgtctccatcattcatcatgttacaggtgtgtggttttatattttttgtccagaaattttctaagatttgatcttaaaa

SEQ ID NO: 4089 - DNA, 201 bp, Homo sapiens
aaaaggataaggataacttcaggggtttcaagaatttactaaagttgtgaggaagatgctaggagttaatttacagactaagaaaaggatgcttgtataamaggaagggtctgggtaagaaaagacagcatgctattgtaggaaaaccaactgactaaccgttagcactttgtttgcaacatatggtggaggaaagtagat

SEQ ID NO: 4090 - DNA, 201 bp, Homo sapiens
gacagaagccagagagccttgggaaaaagtatgtacaattgaattgagaaatggtgctagtcagaggtgaataaaattattttgaataatttttttttgtragataagtgattatatattttcttatattgttactcattgtctaacttgtaaagtcaacacgatatgtacttttgcttcttcaaaggccattccctcact

SEQ ID NO: 4091 - DNA, 201 bp, Homo sapiens
cattaggcagttaattgttgtcacattgtgtattcattgttgcatatggtaattcaggagagctgtaaatatttatttggcctttcactttttttttttttggagacatggacttgctttgtcgcccaggctagagtacagtggtgccatcatagttcattgaaatctcagccttgaactcctggcctcaagcaatccttc

SEQ ID NO: 4092 - DNA, 201 bp, Homo sapiens
gattgcctgagctcaggagttggagaccagcctgggcaacatggtgaaaccccatctctactaaagtaaaaaaaaaaaattagctgggcatggtggtatgmgtttgtagtcccagctacttgggaggcggaggcaggagaatcttttaaacttggaggtggaggttgcagtgagccgagattgtgccactgcactccagcc

SEQ ID NO: 4093 - DNA, 201 bp, Homo sapiens
tggctttgtagtacatgtccttatccttgtaaaaatttagataatactagctagcttttaacagtactatgtgtaaagcactgtgctacagactgacatgwattttttaatcttctaacaacccttgcaggtaggtattatttattagcaaacctgttttataggtgagaatagtgagatccagaaaggttaagtgacttg

SEQ ID NO: 4094 - DNA, 201 bp, Homo sapiens
ttgagttaatcaaatccctcactggagacgttacattgtaaatctggctttggattattttccttctaagttattactctgtactgcttgtacagagtcayatttgtcattttcttacacctgttctgcattcttttggcacttacagtataatttctaaacacctaacattttgctgcttgtttaaaatcatctgcaggt

SEQ ID NO: 4095 - DNA, 201 bp, Homo sapiens
caaggaatgaaggcggaaggagcggtgtggagggaggcggtccgtggcgcctcctgctttgttaatgtgcttcatttcactcttttgattgaatgattgcyggaaagtgcaaggcattaagaattaaactaatgagaaccgaggcaggcggactgactcagattttaattttgattttttttttttttttttagatgaatg

SEQ ID NO: 4096 - DNA, 201 bp, Homo sapiens
aattaaaaggataaggataacttcaggggtttcaagaatttactaaagttgtgaggaagatgctaggagttaatttacagactaagaaaaggatgcttgtrtaacaggaagggtctgggtaagaaaagacagcatgctattgtaggaaaaccaactgactaaccgttagcactttgtttgcaacatatggtggaggaaagt

SEQ ID NO: 4097 - DNA, 201 bp, Homo sapiens
ctcattaactgctcttcccaacattcactctgcccatagcatcaaaattattcttcctctaatctaccttggatcttgctgctccctaggcactcttattscaggtagccaaactccactcacctactaaagttcacttaaaattctcctttcatttatttaatcagtatttatggagcatctattacataccatgtacaa

SEQ ID NO: 4098 - DNA, 201 bp, Homo sapiens
agagctgtaaatatttatttggcctttcactttttttttttttggagacatggacttgctttgtcgcccaggctagagtacagtggtgccatcatagttcrttgaaatctcagccttgaactcctggcctcaagcaatccttctacctccctttcactgttaaatgtgttttgtttgtgttccttgtttcaggtttttgct

SEQ ID NO: 4099 - DNA, 201 bp, Homo sapiens
gtcctccaaattttagagggcttctcattataggatttactaaatgaattatatctttttcacatttacgtatacccgcaggattttataagttctgatcrtggccattgttagctaaaatgtgtaaactttaaaaagagtaaaatcttcatattttgaaaaatagtccagataggcccttcttaacttttagtttcttgg

SEQ ID NO: 4100 - DNA, 201 bp, Homo sapiens
tgaattatatctttttcacatttacgtatacccgcaggattttataagttctgatcatggccattgttagctaaaatgtgtaaactttaaaaagagtaaartcttcatattttgaaaaatagtccagataggcccttcttaacttttagtttcttggtgtcttttgtgaagtatgatgacctgaactatactggttctcag

SEQ ID NO: 4101 - DNA, 201 bp, Homo sapiens
gagtgttttattatacatatgtagataacaggttattttatattgctttacttttaatacctttctcgaggtcatgagcatgttttcgcctgtagcagcaygttgagttaatcaaatccctcactggagacgttacattgtaaatctggctttggattattttccttctaagttattactctgtactgcttgtacagagtc

SEQ ID NO: 4102 - DNA, 201 bp, Homo sapiens
taaatacattaaccagttggcaagtgcaattatgttcattacagtttctgaaattattcttataattacttagaaatcagtgcttagtactttataaaggytttctgtttgtcatctcactttaaatgtaaaacacataatacctagatagacctgagttgaaaaaattgttttatgaaaatcaagagcaactggtaatag

SEQ ID NO: 4103 - DNA, 201 bp, Homo sapiens
aaagatggtaagtatgctttgaaagtccaccccctggatttctttctcatactcttattaaattctcagcttttgctttactagatttttcttaaaaaaawtttcttttattcttgagtacttggttttactttaaacgttgcagtgttgtttaatatattctgtgcaatgtttgaaatcttttaacattttatatatttt

SEQ ID NO: 4104 - DNA, 201 bp, Homo sapiens
tgccagtaaggtcttttaaaatttttgccaagataaaaagtatacagtgaaaaggaagccaattcatagacaaattcagaatcggatacaaggaaaaataraaagcaaaccttcataaacaatagtaaaatgtttgcctgaattcttcatgtgattctttgagtgttggtgacataagagctctctgcattcgattttact

SEQ ID NO: 4105 - DNA, 201 bp, Homo sapiens
attcagttgtttttttagaaaaagtgaacagataacacaaaagaaaacaaggaaaatttaaaatttattgttggtcatgcttatatgccagtaaggtcttktaaaatttttgccaagataaaaagtatacagtgaaaaggaagccaattcatagacaaattcagaatcggatacaaggaaaaatagaaagcaaaccttcat

SEQ ID NO: 4106 - DNA, 201 bp, Homo sapiens
gttattggcatggattttaagtggtgtcttagtgtatctgaataatagttttggtcaggagaccaggatattgtcagttaagctggagtaatgtaatgatraatttttgcccaattgaagccttccaatgtgtctttcaaccaagtgtgcttgcatgtcttttaggtacgaggtacttaagatagccgctgacatattaat

SEQ ID NO: 4107 - DNA, 201 bp, Homo sapiens
gagacacatgataccatctgtggtaagtttttaatgagctctgtttatttcatttttggcaccaaagctttttgcaagaaaaagtaagcaagctccatagrggatgagagtgtgtcttacgtgtttttgtatctatcgtatgggtagatatctatcatgtaggatgtgcttggttcattttttttgagtgcctgagtgaac

SEQ ID NO: 4108 - DNA, 201 bp, Homo sapiens
gttctcatgagcaaattggaagacttacactctagtttcttttccttttttttttttctttaagatggagtttcgctcttattgcccaggctggagtgcartggcacaatctcggctcactgcaacctccgcctcccaggttcaagcgattctcctgcctcagcctccctggtagctgggattacaggcatgtgccaccat

SEQ ID NO: 4109 - DNA, 201 bp, Homo sapiens
gctgaggcaggccagtcacttgagatcaggagtttgagacgagcctgaccaacatggtgaatccctgtctctactagaaatacaaaaaaaaattagctggktgtggtgctgtgcacctgtaattccagctacttgggaggctagggcatgagaatcgcttgaacttgggaggcgaaggttgcagtgagctgagatcacacc

SEQ ID NO: 4110 - DNA, 201 bp, Homo sapiens
cgaaggatactgaccttttggcatttgcattcacttctcctttaacgacgacagttcgtccagggcccatgggggtgttcaaccttgcagcgaatggcagsctctgaaaagaagccacagtcaggaccaagaggcctgcagaaagcgatctccagggaaaactcgtgtccaaagaacactacggaatgtttcagagccatg

SEQ ID NO: 4111 - DNA, 201 bp, Homo sapiens
ccctgtggaggtactgctttcacttcccaccagtgtcccaacttgtgacctttcatcagacttgtttcttccattagtgatctgattgaggtctccctacyataagtaggattttatgtataaaagaagagcttactggctcctgtcaggacatgtggtagatgtttgagttgggaaattttctgagatcctttgtctcgt

SEQ ID NO: 4112 - DNA, 201 bp, Homo sapiens
agaattgcttgaatccaggagacagattttgcagtgagctgagatcacgccactgcactccagcctgggtaacagggagacgccgtatcaaaaaaaaaaaacaaaaaatggagacgtggggataaactaattttttttcaagaagcaagtgagtcatcaagaaaacatgattttaacttgggtcttctgattgtcagaaca

SEQ ID NO: 4113 - DNA, 201 bp, Homo sapiens
tagatttaagtgtttttaaattgacagtttatttcagatgatagctgagatttagcctttaggttgaaaatatgacacttttttattagaaactcactggmctgggaccttaattaggactcttaagaataaatattggctgtctggtcctgcggccatctcctagattgatttccatagcagtctttgtacctcactgga

SEQ ID NO: 4114 - DNA, 201 bp, Homo sapiens
aaagtagatttctattccattaattggagacatggcttcaaggccagcctggccagcatggtaaaacctgtctgtgtgaaaaatacaaaaattagctgggygcagtggcgagcacttgtaattctagctacttgggaggctgaggcaggagaattgcttgaatccaggagacagattttgcagtgagctgagatcacgcca

SEQ ID NO: 4115 - DNA, 201 bp, Homo sapiens
atgagccaccacatccagtccaacttacatgttttaaaagtagatttctattccattaattggagacatggcttcaaggccagcctggccagcatggtaawacctgtctgtgtgaaaaatacaaaaattagctgggcgcagtggcgagcacttgtaattctagctacttgggaggctgaggcaggagaattgcttgaatcc

SEQ ID NO: 4116 - DNA, 201 bp, Homo sapiens
agctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactagaaatcagtgtttgggactgtattataaat

SEQ ID NO: 4117 - DNA, 201 bp, Homo sapiens
tcagaaggctggacgtctgtggaaaaagttgttaaagcagaaattttctaaatcacatgacaagaggggccctaaaaaatgttgcctgggctgggcgtggygactcacacctgtaatcccagcactgggagggcgaagtgggcggatcacttgaggtcaggagttccagaccagcctggccaacatggtgaacccctgtct

SEQ ID NO: 4118 - DNA, 201 bp, Homo sapiens
ctgtctggtcctgcggccatctcctagattgatttccatagcagtctttgtacctcactggaaggaggacggagcagacagtctctttgaggcgtaagcarcctctcagtattctttgtgcactggctcctgcctctcagcgtttctccttcccaagtgccttcttgcctgctgccttcccaggtgccctgtggaggtact

SEQ ID NO: 4119 - DNA, 201 bp, Homo sapiens
agtggctttaactggctataagtgttgctgcccccagtttccccattcagtgctagacaccaccatacttcatggcaaggactgagaacacccagcaggayctaatggtgcacaagctcattttaacaatataaacaatagaatgacagtgagatgcgtttcagcaaggccagtatcacagaagccattctgtattttggt

SEQ ID NO: 4120 - DNA, 201 bp, Homo sapiens
atgcaagaattttggtgcagaaaatccagatccttttgtcccagtgctgaacactgctgtgaaactgattgctccagagagaaaggaggagaagaatgtcytgggaagcgcgctgctgtgcatagcagaggtgacctccaccctggaggcgctggccatcccccagcttcccaggtatgcggccggagacttggaacagga

SEQ ID NO: 4121 - DNA, 201 bp, Homo sapiens
aagtgggaaacaattttgtattttgagagaggttgatataaaaattatttctggaatttaaacttgttcactgaactcagttgccttttttctaccccctytagattacaaaaccattttttgcagccatatcagatgaaaaagttcagcagaagcttttaagaatgttgtttgatttattggtgaactgtaaaaactcac

SEQ ID NO: 4122 - DNA, 201 bp, Homo sapiens
cataaactaaacatctaacaacagaggcaaatggatagataagtggtatttatagaggaatatcatatgcagttaaaatgaaggaactagaacataagtcmccatgcatagatctcaaaaatatgtttccagaaaaacatgttgttccgtgatatgtagtgtttgaaacatttggaagcagatttgggatgatggttttgt

SEQ ID NO: 4123 - DNA, 201 bp, Homo sapiens
gaggatttgagtcagagctccttaacctggggttctccatgagctttaggggatcttaatctactgaaatcatatgcaaagttttatctgtatgggatttytttttttcttgtaagagagtctgtgcttctcaaaggggttgataatccagaaacagttaagaatcattaatattttttctgtttttattgaaatatagtt

SEQ ID NO: 4124 - DNA, 201 bp, Homo sapiens
tggaattcttgcttactacagagcttacgtggccttagccttagcatagttctaagtcccttttactccagatcagtgggtgctttgtataagtgaaacastggctagaacatgcacatcgcttagcatgactgtgtgactcaggacccccgagtctgatttccatttagacaatctcaagctgtgacaatgggaaaatgg

SEQ ID NO: 4125 - DNA, 201 bp, Homo sapiens
cccatccttgttcaacttgttgatacactgggtgcagagaaattcctctggattctcctcatcttgctttttgaacagtatgtcacaaaaacagtgctggyggctgcctgtggcgaaaaggtcagaacctagggtgggaagataaggaaaatggtgatttctcacacagattttatgatattgtccagtttaaacatgggg

SEQ ID NO: 4126 - DNA, 201 bp, Homo sapiens
gaggcaaatggatagataagtggtatttatagaggaatatcatatgcagttaaaatgaaggaactagaacataagtcaccatgcatagatctcaaaaataygtttccagaaaaacatgttgttccgtgatatgtagtgtttgaaacatttggaagcagatttgggatgatggttttgtttgtggggcttggggtagaggga

SEQ ID NO: 4127 - DNA, 201 bp, Homo sapiens
tgaaatgctgaagtacattgcccttaagttttagaacattgaagctaagaagcagtcttggcaatgtctttctcaataatataaacaaacgtgttatagcyggttctgctgtgctgtgagtgtgtaactgtaagtgtcttaacatcattcgggtggggtaaattgacatccaccatctatttcaggacattgcatcagttt

SEQ ID NO: 4128 - DNA, 201 bp, Homo sapiens
gtcaccatgcatagatctcaaaaatatgtttccagaaaaacatgttgttccgtgatatgtagtgtttgaaacatttggaagcagatttgggatgatggttktgtttgtggggcttggggtagagggagaataggaccaaggagcagtacttgggggattccagctgaatctgtaatgtttaacttctcaacaaaggatatg

SEQ ID NO: 4129 - DNA, 201 bp, Homo sapiens
ttaaaactcttgtggctgagtgtggtggcatgcacctgtaacaccagcactttgggaggctgaggtgggattatttgaggccaggagtttgagaacagccyggtcaacatagcaaaaccccgtctctacaaaaatttttaaaaagtggtggtggggtcctgggatgtcccagcttcttcggaggctggggcaggaggatct

SEQ ID NO: 4130 - DNA, 201 bp, Homo sapiens
ctacaattcgaagcagaacgacaaggcacgttagaaggaaggtactctaagagctccgcagagactgttttctgcgtggccagccattggccctgtcatcmctgtttggcgaggcagtaacttgtcccatcctgcagtcagctcaggtttggcagggacagacgagggaggtccctggacagtatgtggtgtatgtggtat

SEQ ID NO: 4131 - DNA, 201 bp, Homo sapiens
cagagactccttccgtgatgtggtttcttccatttgattgtccagtttccctgttttgttttttgtcttaaacactcgcttctcagggccactgggtactytcttggcaaatacactcacgtttttcactaatttagaagaggagaaactggatgtaatagatgaacacatttctctgggaaaatgttatcccgttaattg

SEQ ID NO: 4132 - DNA, 201 bp, Homo sapiens
cctcctgctttgttaatgtgcttcatttcactcttttgattgaatgattgccggaaagtgcaaggcattaagaattaaactaatgagaaccgaggcaggcrgactgactcagattttaattttgattttttttttttttttttagatgaatgtgaagaagtagaacatcagtgccaaaagactattcagcaactggaaact

SEQ ID NO: 4133 - DNA, 201 bp, Homo sapiens
cctctagcgatgaagaattcacttggtgtgttagtgcttgaacaaaatactatttcattcaattgtttactaaaaatagatcttttaggctttaaataatkttaatattacatagatgtgtatccctccagcctactactgtctttcatagtattactaaaggacatgtttcagctgtttacatttgacatgttttgaggt

SEQ ID NO: 4134 - DNA, 201 bp, Homo sapiens
ggtcagaacacggccttagtcggctctgctgcccactggctgttcacaatctaaccacctcctgcttgaatcatctcactttggaaatgaagattctgacrctagcccttcttccagctcacaggaccgttcacgggtggaaggcggtaacaggcacggaagtatctgcactgtgactggtaccgaaggatactgaccttt

SEQ ID NO: 4135 - DNA, 201 bp, Homo sapiens
aacaaaatactatttcattcaattgtttactaaaaatagatcttttaggctttaaataattttaatattacatagatgtgtatccctccagcctactactrtctttcatagtattactaaaggacatgtttcagctgtttacatttgacatgttttgaggtagcaagactttttttttaatatctgctatatgtaaggatt

SEQ ID NO: 4136 - DNA, 201 bp, Homo sapiens
tttttgacatgcttttgatttacatttttgtgactcagtataattttcaagattggttagaaatttcccagcattcctttttaatgtatatcttgttttgyctgtatcatttcattaactataagtacttaatccagtaactggcagcattaaaagcaaaagtaatttttcttgcatgtctttagtgcttatagatgaaaa

SEQ ID NO: 4137 - DNA, 201 bp, Homo sapiens
agatcacaccactgcactccagcctgggtgaccaagtagactctggaaaaaaaaaaaaatctaataaaaggcaatgtatggtactgtttaaaaaaagtacmcgatgtaaaaggataggagagttttcacagaagagggatcagttggcagaattagaaaaaacatcttagccaggcatggtggctcacacctgtagtccta

SEQ ID NO: 4138 - DNA, 201 bp, Homo sapiens
ttatcttttcacacatgtattgtttcttttgtttgtttgagacagagttttgctcttgttgcccaggctagagtgcaatggcatgatcttgggtcactgcyacctctgcctcctggtttcaagtgattctcctgcctcagcctcctgagtagctgggactacaggcacgcaccaccacgcccggctaattttgtattttta

SEQ ID NO: 4139 - DNA, 201 bp, Homo sapiens
acagccttctatttgaagagtatatttcatatagttcacaggaagaaatggattctaataaagtgtctttgcttaatgaacaatttcttccactcattagrcttttagaaagcaagtaagttacgtgtgtatgtttatgctcttctaaagtacttcctgttctataaagatatgattcacaagtcacatcttaatatactg

SEQ ID NO: 4140 - DNA, 201 bp, Homo sapiens
aattgtttactaaaaatagatcttttaggctttaaataattttaatattacatagatgtgtatccctccagcctactactgtctttcatagtattactaarggacatgtttcagctgtttacatttgacatgttttgaggtagcaagactttttttttaatatctgctatatgtaaggattttgtttttatttgtcctcca

SEQ ID NO: 4141 - DNA, 201 bp, Homo sapiens
cgtggcccactcgatctccagggctcaaatgatcctccgatctcagccacccaagtagctgggattacaggcatgcaccaccatgcccacctagttttttktttgtttgtttgtttttgtttttgtttttccattttttgtagagacagtgtctcactttgttgcccaggctggtctggaactcctggcctcaagcgatcc

SEQ ID NO: 4142 - DNA, 201 bp, Homo sapiens
tgggaagcgctgtgaagagttgttgccttccaagatatacccaaattcccagttccaggtaagcggcacagagccgcttgatgtggctgcggatgggggcrgcatatcgagggagggtaagagttttccggatatctgcggaatcagggttgaaggaaagccttggcgcggtcgccgctactgtaattagttgttaacgct

SEQ ID NO: 4143 - DNA, 201 bp, Homo sapiens
ataggaattggctggaccatgttgagggatatgtgaatgcaaaattggggactttttaaatgctctgtatcttataattttgtgatttttactgctactcrttctaggttgttttagcttattaataatacagtttgggcatgtgaggaaataggtgcttattattaagttttgtgttcagttggactgtttgcttttttt

SEQ ID NO: 4144 - DNA, 201 bp, Homo sapiens
tctcttctgtcccgtcctcttccttagcagtttctagcatgttgatgtatatttttaagggaaagagaacataacagtcaggtgcttggtgcttgaaatgyttatgagtagaggtatctggatttcacagatgaagaaacaaaattagagaggtcaactaatatgtcaaagagaagaacagctaaaagggggatggaggca

SEQ ID NO: 4145 - DNA, 201 bp, Homo sapiens
ccccaaatagatcattaatgtaaggaatactttttgcatttgatttttcattttatgtcttcagataacttatttattcagcaaatactaagttcagtacwtagataagtaggttgccgttgattactgttttgaaataaatgccataataaaggattaagcagagttttgtggatatagttctgcctggaatagttgaag

SEQ ID NO: 4146 - DNA, 201 bp, Homo sapiens
gcataggagtggccctggggaaatttgaagatgtccttggtttttttttgttttgtttcttgttgttttttttttaattccaaaattactctttgtaaatrttctgtgaaagcaagttagatgatcatatacttttccctgaacaattcctcagtgtttattttttgttagttctttgaaagagcacataattacatttgt

SEQ ID NO: 4147 - DNA, 201 bp, Homo sapiens
gtggggtcagtgttcagaattagtaagataggagtaatgaggactttttaattagaaggagaatttaagaatctgaacgtaaagcacttgaactaaagaaygttggagaaggccagcctttgataaagctcattaactgctcttcccaacattcactctgcccatagcatcaaaattattcttcctctaatctaccttgga

SEQ ID NO: 4148 - DNA, 201 bp, Homo sapiens
tgaacccaggaggcggaggttgcagtgagccgagattgcaccattgcgcaatgtccagctcatatgtgatagcagttggtgtagaacagagtttatagtaygctcttgtgtattttcaaaagaatgcaccaggtaacatatgcctaacctttctctggaatattaaatattcaaacagtgaacagagaaggagtttgaatt

SEQ ID NO: 4149 - DNA, 201 bp, Homo sapiens
agaatgttggagaaggccagcctttgataaagctcattaactgctcttcccaacattcactctgcccatagcatcaaaattattcttcctctaatctaccytggatcttgctgctccctaggcactcttattgcaggtagccaaactccactcacctactaaagttcacttaaaattctcctttcatttatttaatcagta

SEQ ID NO: 4150 - DNA, 201 bp, Homo sapiens
atagatcatttgatttctaaagcagaggagatcacttcagatgctgcctatgttattcaggtaagctcgttagcaaagaagattgagtgtgttcatgcctstgtgtactggagcaattttctccattctcgacatttcactgtgtagggattttgatggactaagtcattggatttaggaactgataggtcaatatctgta

SEQ ID NO: 4151 - DNA, 201 bp, Homo sapiens
tttgatggactaagtcattggatttaggaactgataggtcaatatctgtacatctgtgtccccctacttttgaaaagatagcaatgtcatatttcaatttwgttcttttcattggataaaggtttagtgtgtagcttttcatagtaagccagctgtgtgtttttaataacgtttcttattaaggttttaaggagaaatgga

SEQ ID NO: 4152 - DNA, 201 bp, Homo sapiens
tttaggaactgataggtcaatatctgtacatctgtgtccccctacttttgaaaagatagcaatgtcatatttcaatttagttcttttcattggataaaggwttagtgtgtagcttttcatagtaagccagctgtgtgtttttaataacgtttcttattaaggttttaaggagaaatggaaaattataaacaatgtcacatc

SEQ ID NO: 4153 - DNA, 201 bp, Homo sapiens
catgttggtcaggctgatctcgaactcctgtcctcaggtgatccgcccaccttggcctcccaaagtactgggattacaggcgtgagccagcaccatttaaratagcaatgtagtcttactatgttgttcagacaggtctcgaactcctgaccttaagcagttctcctgccccggcctccgaaagtgctgggattataatgc

SEQ ID NO: 4154 - DNA, 201 bp, Homo sapiens
aatgtagtcttactatgttgttcagacaggtctcgaactcctgaccttaagcagttctcctgccccggcctccgaaagtgctgggattataatgccagtgrtgtgaaccactacaccaggcctctagtttctttatctgtaaaataagtattaaactataccttgtataagtatgacaattagagataatatttctaaagc

SEQ ID NO: 4155 - DNA, 201 bp, Homo sapiens
attttgtatctgatgcctgactctcctctcttttattgtctttattggataattacccaagctacacctaactacctctagcgatgaagaattcacttggygtgttagtgcttgaacaaaatactatttcattcaattgtttactaaaaatagatcttttaggctttaaataattttaatattacatagatgtgtatccct

SEQ ID NO: 4156 - DNA, 201 bp, Homo sapiens
taatttccagcgtgtcaatactgctgagctctttaaatctgtgtttgtactccaggctgtgtacgccatttactgcaaccttgaattctctaacatcacartaaattatcatctgaaaggaaaggatacatgccattagtggttccccttagtttaaaattttgtgtttgttacatgctaacggtgtcagagtaaaccatt

SEQ ID NO: 4157 - DNA, 201 bp, Homo sapiens
ttggggtagagggagaataggaccaaggagcagtacttgggggattccagctgaatctgtaatgtttaacttctcaacaaaggatatgtgagctcaccagmtcagcatgtcatagaattcggtagtgctaattgagtgttgattgctgtatttttctgaaccattgtagtactttttagatactaccagtagaatgtaatt

SEQ ID NO: 4158 - DNA, 201 bp, Homo sapiens
tgtgaactaatgtttaaaaagttagagcttgtctcaagtcagtacagctcttaagataataaatacagtaacactactttttatttctttgctcttttatycctttcaggttcgatttgctgctttgattactgtgttagcactggctgaaaaactaaaggagaattatattgtcttgctaccagaatccattcctttctt

SEQ ID NO: 4159 - DNA, 201 bp, Homo sapiens
tatttgtttctttataattgtacactagtgagaagaggatttggaaccagcttatttgagtaagaattaaaagtttgcttttttttttttttaattaggtkcatctagaagatgtttttcagttattcaagttctgttctgttttatggacctatggttctagcctttcaaatccactaaactgcagtgtgaaaacagtgc

SEQ ID NO: 4160 - DNA, 201 bp, Homo sapiens
aagaaattgaagttaccacctaagtgggtaatgatacagatgagttgaataaacctcatgagagtaccttagactaatatttaggactgtgtatgccagtygtccccattttaacaataacctaataacaactacttttatgtttccacattgacagttgtttatctttagtgtttttcaaactggaatttgtagattaat

SEQ ID NO: 4161 - DNA, 201 bp, Homo sapiens
ggctgctctgcagaaggttgtggagactctcccgcacttcatcagcccctatctggaaggcattctctcccaggtgagccacgatagccacgacatgctaygcagggtggctggggaaggtaaaagatcacaaatgtagtgattttgttttttctttaagggttagtttccgtttgacagaaaggagtcttatttctgaag

SEQ ID NO: 4162 - DNA, 201 bp, Homo sapiens
acacaggtgattgtttggataaagccctgtttggataagtcgaggaccatttttaaatgacttcttagacatgggatctgggagtagatctcgacccactstaaataaagtagtatactctgttctgctagaaatcctaacgcacattatcctgaaattatgccttcacaattcctaagtacagatttgttacctttttct

SEQ ID NO: 4163 - DNA, 201 bp, Homo sapiens
agtcttttatcaccaaaggtgtttttctacaaaaataaatgtctattccttgccagattctagttacagtgactattcaaagagagtgtctagaaatgtcrggaatattcaacctgggaaagctgtttaaaaaattttaaggccaggtgcggtggctcacgcctgtaatcccaacactttgggaggccaaggcaggcggat

SEQ ID NO: 4164 - DNA, 201 bp, Homo sapiens
ggcggctgcctgtggcgaaaaggtcagaacctagggtgggaagataaggaaaatggtgatttctcacacagattttatgatattgtccagtttaaacatgrggctgatgatgcctaatgtgtgttatttagaacctttttgctcagaacctttttcaaaaaggtttttggcattttaaaaaattgcattcagagcccatag

SEQ ID NO: 4165 - DNA, 201 bp, Homo sapiens
gaactaattagtctcaccactgttatataatattgttattcctcaaattagaaaacagagtagaaaaaaagatttcctgtataatacaaacataaacttayaaggtaccaagaataagcctgacaaaaatatgtgcacaaatattacaggggaaatgtgcaagatatgaagggacacagaagaaaacttggaagaaataga

SEQ ID NO: 4166 - DNA, 201 bp, Homo sapiens
gcattttaaaaaattgcattcagagcccatagcactctgaatatcctcagttgcagcaaaacatctgaaggcgaattaacttttctgagaaacagttctgstgccacgcaagtggttctcttttaagcccagcagagtatggctgaagagtaatgaaacagtgtctcttcaaagcggttttgaaggcagtttgtggggaaa

SEQ ID NO: 4167 - DNA, 201 bp, Homo sapiens
tgggttatatgttcatttctattaatatttctctttatataaatggtgtatggtgtgtgtgcatgtgtatgtgtgcgtgtgtgtgcctgtgtgtgtgtgcrcgcacacacctgccattaacctagggccataactccctgaacaccccacttggacagcccagtgagatccactgagcatgagctagatatgagtgagttc

SEQ ID NO: 4168 - DNA, 201 bp, Homo sapiens
agcaatttattaaaatagttattttctgctaaacttgtgggttttcaaaaaggtacatatattttatttagagataactatttctgttttccaatttggtrttaaatgtttactgtcctttgacagtggcctctgagtcatatatgtcattttgactgtaaatagcaagatggaagaacttcagttttccattggtattgc

SEQ ID NO: 4169 - DNA, 201 bp, Homo sapiens
actttactggctataacagaccaaagcagaattttattaataggatttattagttcaaattctttattaggatatgctaacaatgagactattatgatgamcccccacattttaaaccataggtttttatacaagtagcagtatcaaatttattgtaatattttactttgcacaaatcaaggaaatcctgattgaatctag

SEQ ID NO: 4170 - DNA, 201 bp, Homo sapiens
tttgagttttgttttgttgttttgagacagggtcttgctctgtcacccaggctggagtgcagtggtgcaatctcggctcgctgcaacctccacctcccggkttcaagcaattcttgtgcctcagcctcccgaatagctgggatcacaggcgcccgcctccacacctggctaatttttgtatttttagtagggatgaggttt

SEQ ID NO: 4171 - DNA, 201 bp, Homo sapiens
ctccagagagaaatgcattgaatttatccacactatagtcttttgagttagagcaatacattctgttgtttatagatactaggcttatgatcttgttgagyaagtggtggcagtggaaataaaacatgggtaggttgagtggaagtcaaaatttgacacccaagtgttacgaatttcaaactgttttagcaatgagtcacc

SEQ ID NO: 4172 - DNA, 201 bp, Homo sapiens
agctctttaaatctgtgtttgtactccaggctgtgtacgccatttactgcaaccttgaattctctaacatcacaataaattatcatctgaaaggaaaggawacatgccattagtggttccccttagtttaaaattttgtgtttgttacatgctaacggtgtcagagtaaaccatttgattatacatagaaaagttccagcc

SEQ ID NO: 4173 - DNA, 201 bp, Homo sapiens
ttgtgctccagagagaaatgcattgaatttatccacactatagtcttttgagttagagcaatacattctgttgtttatagatactaggcttatgatcttgytgagtaagtggtggcagtggaaataaaacatgggtaggttgagtggaagtcaaaatttgacacccaagtgttacgaatttcaaactgttttagcaatgag

SEQ ID NO: 4174 - DNA, 201 bp, Homo sapiens
atttcttacaaatgctttaatattcaggcgtgggttcaagtgtagagcaatatcctttgattttcctgctagtaggtcaacattaaagcttttgagaaagraagaaaaaaaaaaaccttaattaaccaagtaggacagagtagtggcaatttcagcaatgttagtgaccagacttgaactatgattctaactctatgaaac

SEQ ID NO: 4175 - DNA, 201 bp, Homo sapiens
cttgaaccaggtgaacatctccaaaacaggtgggtggtcgcttcagttcagctgtcacccttgccctgtgtgccttatacaaggtaccagtaagacacaasctagtgcttggaagcaagattttagaggttcttaagtcctaagctaaggagggtgaattttttacttcattgttgtcagacagtgaagtgttgttttagc

SEQ ID NO: 4176 - DNA, 201 bp, Homo sapiens
atgtgccatttaagtggattgtacattcctgtgatgttactaaagaattgttgtaactgcttgtgggtgaagaagacaattgtaagagttgcatgtgtgcrctcagaagagataaatgtaatattaatttgagagggggatgagttgaggtagagaaaaacagatacaagatacaaagacaagtactggtgagtttctttt

SEQ ID NO: 4177 - DNA, 201 bp, Homo sapiens
acgcagacaaactcaccgtgaagttctggcgcgcgctccttagtaaagcttacgacctgttagataaggtaggtgttcatttctccctggaattactgttytgttgctgttttttaaattattgtgaaattatgtaaagtttttaagaataaacttagcaattccttttatgaatataatgaagctcagatttttcttaga

SEQ ID NO: 4178 - DNA, 201 bp, Homo sapiens
tagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcggccacaatcgacagggacaccgccttcgccattggtgagccatcttttaacttagaaa

SEQ ID NO: 4179 - DNA, 201 bp, Homo sapiens; identical to SEQ ID NO: 921

SEQ ID NO: 4180 - DNA, 201 bp, Homo sapiens
gcaggaggatcacttgaggccaagagttcaagaccagcttggacaacgtgatgagatcctgcctctacaaaaaatacaaaaattagctgggcgtgatggtrcgtgcctgtagtcccagctactcagttgcctgaggtaggcagatggcttgtgcctgggaggtcaaggctgcagtgagctgtgattgcaccactgcactcc

SEQ ID NO: 4181 - DNA, 201 bp, Homo sapiens
agctacaaaagtacattctcctttgtttcttagctcttggaggggggaggtgtgagctactaaaggggtggcatccctaggaagtttgagttttggggattcttattcagcttccagtgcaagcctgtgggcaaggaatgaaggcggaaggagcggtgtggagggaggcggtccgtggcgcctcctgctttgttaatgtgc

SEQ ID NO: 4182 - DNA, 201 bp, Homo sapiens
acgttgcataaaattggaatttgttaaagaattgatcttgcagggtgtggtggctcacggctgtgatcccaccactttgggaggccaaggcagggagatcrtttgagcccaggagtttgaggctgcagtgagctatgactgcaccactgcactgtagcctgggcaacagagtgagaccctgtctcttaaagaaataataat

SEQ ID NO: 4183 - DNA, 201 bp, Homo sapiens
aacagctcccaaatggtgaaactggtattctaagatgaaagcttaatgaacataatgaagtgaataaacgcatgtgaactaatgtttaaaaagttagagcytgtctcaagtcagtacagctcttaagataataaatacagtaacactactttttatttctttgctcttttatccctttcaggttcgatttgctgctttgat

SEQ ID NO: 4184 - DNA, 201 bp, Homo sapiens; identical to SEQ ID NO: 922

SEQ ID NO: 4185 - DNA, 201 bp, Homo sapiens
tgcctgaggtaggcagatggcttgtgcctgggaggtcaaggctgcagtgagctgtgattgcaccactgcactccaaactgggcaacagagcaagaccctgkctcaaaaaaaaaaaaaaaagggctgtacatctatacatatttctggtcacttctaagtattgcttttaagttactggcactagcaaaatctcaccaaaca

SEQ ID NO: 4186 - DNA, 201 bp, Homo sapiens; identical to SEQ ID NO: 924

SEQ ID NO: 4187 - DNA, 201 bp, Homo sapiens
tggccctgatttctatgggctcatgaattctttattctgtggattctaatccatatgctgccattatatatttgggtgcaggaattttcctttctctcccwtgtcctcggggtttgcctcctggccttgctgtgtacctccttttcagatgcatggcattcccagggccactgtcctgccccttccactggaaagtgcctg

SEQ ID NO: 4188 - DNA, 201 bp, Homo sapiens; identical to SEQ ID NO: 963

SEQ ID NO: 4189 - DNA, 201 bp, Homo sapiens
ccaggacacacccatttactgtactttgctttatcaaagagctgcatttaactcccttcaatttctctagtggtacaatttcaaattgaagtatattattwtctgaatataataccatgacatgttttaaaatgtgacgttaattctaacgggaatatatgtgtgttgtaagagctcttagaatggaatttcagcctagtg

SEQ ID NO: 4190 - DNA, 201 bp, Homo sapiens
acactatttataaggttgcacatattacaaacagctcccaaatggtgaaactggtattctaagatgaaagcttaatgaacataatgaagtgaataaacgcrtgtgaactaatgtttaaaaagttagagcttgtctcaagtcagtacagctcttaagataataaatacagtaacactactttttatttctttgctcttttat

SEQ ID NO: 4191 - DNA, 201 bp, Homo sapiens
aggagacctgccagaggtggctggaggcactttattgccagcctggcgggctggcgagcgccaatgaagtaaaatctggtgacacacttgagtttgcatgyggcattttattttattggttttttttaaaggaagagattataaaaagacatttcacattaaagatttgcagtcctgggacacagtttggaaaacactatt

SEQ ID NO: 4192 - DNA, 201 bp, Homo sapiens
ttttaaagccccaaaactaggatattgtgacacagaatgttttttattcagtgctgagatgggagtttatcccaagcgactgtcctggcccctcatacaaytatagtggtgaccagtcaggggctgtgggtgaggagacctgccagaggtggctggaggcactttattgccagcctggcgggctggcgagcgccaatgaag

SEQ ID NO: 4193 - DNA, 201 bp, Homo sapiens
gccttattaaataaacctttgtaaaggattagatgtgtgatttaaatacattaaccagttggcaagtgcaattatgttcattacagtttctgaaattattmttataattacttagaaatcagtgcttagtactttataaaggctttctgtttgtcatctcactttaaatgtaaaacacataatacctagatagacctgagt

SEQ ID NO: 4194 - DNA, 201 bp, Homo sapiens
tttctaaacacctaacattttgctgcttgtttaaaatcatctgcaggtttggagatttttgccatgtaccttattcagattagtggtaaaacagtgaaatsaaagaattccctttaactatgtcttggcaatccaactgtttatcttcctgttttgaaatatacctattttggccaggcacggtagctcacgcctataatc

SEQ ID NO: 4195 - DNA, 201 bp, Homo sapiens
atacttttccctgaacaattcctcagtgtttattttttgttagttctttgaaagagcacataattacatttgtaaccaaattttgttacatttaaagtagwtatgtaatttcaagttttatttctaaaataaaattccacaaaagtaattttttattcgcttacaaaatttcggtctttattttaggtgagtttactgtta

SEQ ID NO: 4196 - DNA, 201 bp, Homo sapiens
ataaaattccacaaaagtaattttttattcgcttacaaaatttcggtctttattttaggtgagtttactgttaaggtttttctagttatatttggataagracaactctatacattttttaactttaatttttcaattaatatggacatctttccatattaataaatggaaaaatttatctttttacaactgcctgcagag

SEQ ID NO: 4197 - DNA, 201 bp, Homo sapiens
acatattaattaaagaagagatactgagtgaaaatgatcagttgtcaaatcaggtggttgtatgtttgctgccatttatggttatcaataatgatgatacrgaatctgctgagatgaaaattgctatatatttatcaaaatcaggaatctgctccctgcaccctctattaagaggctgggaagaaggtaaaaaattcagtt

SEQ ID NO: 4198 - DNA, 201 bp, Homo sapiens
aatgtattcttcctattctgaaggtaatgagtaatgtcccagtctttgaaagcaagggctaagatcagattcatatgtttattataaatctgaaatagatracagcttttggttcagtaagggggtgggtactgagataaaagtttaacctcttttcagagatagttgattggcaccatcacaactaatttgtaatgtgac

SEQ ID NO: 4199 - DNA, 201 bp, Homo sapiens
atctctataatcaagatagcctcattgcttgtgttctgccataccacgagacaagaatatttgtgcgagtcatacagcttctaaaaattaataattcaaarcacagatggttctggttgttgccagttaaggtataattgctgaatgacatatgtctgtaatcattacagatcttgattaagggatttaattaggaaaaaa

SEQ ID NO: 4200 - DNA, 201 bp, Homo sapiens
agacatttacatgaaaagaaaaaaagtaggtaccacaggagtggcagcaaaatattaaaattgtaccatgcagcagagccttgaagaaaatcccacgaacygcagcaccactgaggctggcttaggaaagggttgatgaagccaggtgtgatggtgttagcctgtggtcccagctacccaggagaatgagacaggaggatc

SEQ ID NO: 4201 - DNA, 201 bp, Homo sapiens
gcagggacagacgagggaggtccctggacagtatgtggtgtatgtggtatatgtggtgatgtgggtaaggaagtgtcttagcagtaagtcattctataggmtagtggtttttaacactgcactgccaaccccatttacattagacacattgaataaagaaatctacacctgcagttggaagttcagagactccttccgtga

SEQ ID NO: 4202 - DNA, 201 bp, Homo sapiens
cagggacaccgccttcgccattggtgagccatcttttaacttagaaaagctcttggaagcgtttgttttctggatgttactgttttttttttttccccttsttttctcttctgtcccgtcctcttccttagcagtttctagcatgttgatgtatatttttaagggaaagagaacataacagtcaggtgcttggtgcttgaa

SEQ ID NO: 4203 - DNA, 201 bp, Homo sapiens
cttgtgggtgaagaagacaattgtaagagttgcatgtgtgcgctcagaagagataaatgtaatattaatttgagagggggatgagttgaggtagagaaaamcagatacaagatacaaagacaagtactggtgagtttctttttattttaaaattaaatgtgttgtccctgtctaatcattaagtttattttaaatgaactt

SEQ ID NO: 4204 - DNA, 201 bp, Homo sapiens
ttgttcctgcacacttgaggcagtgagtactaagctgctttcttggcaaaataacaagatggttggggaagcaggcaatgttatcctctgaaataccattrcttgagaaaaacaatgatagctaatgtgtttttgagcatttatacactaggccctggtaagcactttatctgcattatctcatttaattctcacagcatt

SEQ ID NO: 4205 - DNA, 201 bp, Homo sapiens
atgtaatattaatttgagagggggatgagttgaggtagagaaaaacagatacaagatacaaagacaagtactggtgagtttctttttattttaaaattaartgtgttgtccctgtctaatcattaagtttattttaaatgaacttaacagtctcgtgtctcatggggctgcactgctgaaagaagctgttggttcatctct

SEQ ID NO: 4206 - DNA, 201 bp, Homo sapiens
atggatgattctgtattgcattactagttgtccactctaagggatgagcgtgaaattgagtgactctggactggagaagtgatactgtatcataatcaagwcaagtgcagggctgtaacttgagactcccaagacaaattgtatagaaagcaagtgcatggtagtaggagagcttggttaaaatgaaaatctgaagttgaa

SEQ ID NO: 4207 - DNA, 201 bp, Homo sapiens
gtgactttttttttttttcctctgagtagacgttgcataaaattggaatttgttaaagaattgatcttgcagggtgtggtggctcacggctgtgatcccascactttgggaggccaaggcagggagatcgtttgagcccaggagtttgaggctgcagtgagctatgactgcaccactgcactgtagcctgggcaacagagt

SEQ ID NO: 4208 - DNA, 201 bp, Homo sapiens
gggaggccgaggcgggcggatcatgaggtcaggagatcgagaccatcctggctaacatggtctctactaaaaaatacaaaaaattagccgggcgtggtggygggcgcctgtagtcccagctactcgggaggctgaggaaggagaatggcgtgaacccgggaggcatagcttgcagtgagccaagatcgagccaatgcattc

SEQ ID NO: 4209 - DNA, 201 bp, Homo sapiens
tctgttgccgaggctggagtgcagtggcgcgatctcagctcactgcaagctctgcctcttgggttcatgccattctcctgcctccgcctcccgagtagctrggactacaggcacccgccaccacgcccggctaatttttttgtatttttagtagagacggggtttcaccgtgttagccaggatggtctcgatctcctgatg

SEQ ID NO: 4210 - DNA, 201 bp, Homo sapiens
tgtttgtttgtttgttttgagacggagtctcgctctgttgccgaggctggagtgcagtggcgcgatctcagctcactgcaagctctgcctcttgggttcaygccattctcctgcctccgcctcccgagtagctaggactacaggcacccgccaccacgcccggctaatttttttgtatttttagtagagacggggtttcac

SEQ ID NO: 4211 - DNA, 201 bp, Homo sapiens
gtaaatctcataatgtcatgcactttcatccctctgtacttcagtgtgcatcttttgaaaagtggatatgactacaatgccattagaagtaaaaaaaaaaataattccttggtattatctaatacctagttcataatcatatttccatggttatcacaaaagtattttttatagttgttttctttgaatcagaatccaaag

SEQ ID NO: 4212 - DNA, 201 bp, Homo sapiens
tggatgattctgtattgcattactagttgtccactctaagggatgagcgtgaaattgagtgactctggactggagaagtgatactgtatcataatcaagamaagtgcagggctgtaacttgagactcccaagacaaattgtatagaaagcaagtgcatggtagtaggagagcttggttaaaatgaaaatctgaagttgaat

SEQ ID NO: 4213 - DNA, 201 bp, Homo sapiens
aaaaatgcagcagaagtaagagctacaaatgcattgagcacatgctgttgttccctgactctgaatgttatgaaaccattggaactttttgatactcatcratttgctataatcaggcacaatggtttttacttagcacatgatagagtttgcttttccaacgttttgtcttctccattttccagaaaatcacaagatcta

SEQ ID NO: 4214 - DNA, 201 bp, Homo sapiens
aggttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatccttttgtcccagtgctgaacactgctgtgaaactgattgctccagaga

SEQ ID NO: 4215 - DNA, 201 bp, Homo sapiens
tgaatttatatagatatagatatgtgtgtatatagtgtttgctatctaaatatattttcatatatatagatgtatatattctatatacgtagatttgtgtrtgtgtgtgtgtaaattgagtatgaattgtagcgtgtgctttcatgtgaaaggcaaagtaattctgaaggttgtcctgtaagattccagataggctaatgg

SEQ ID NO: 4216 - DNA, 201 bp, Homo sapiens
gtggcgtgcacctgtaatcccagctgctcaagaggctgaggcaggagaattgcttgaacccaggaggcggaggttgcagtgagccgagattgcaccattgmgcaatgtccagctcatatgtgatagcagttggtgtagaacagagtttatagtatgctcttgtgtattttcaaaagaatgcaccaggtaacatatgcctaa

SEQ ID NO: 4217 - DNA, 201 bp, Homo sapiens
gcattcctgctgaaatcatcactctcattgaacatgattctagaagtactagccggcagaaatagacaagtttcaaatacttatggaatgtatgaatatartaaaggcaaaatcaaagatctgtgagatggttatgtggattgttaaatgggacatctggctatccatttggaaacattaggaagtttgactccaacctca

SEQ ID NO: 4218 - DNA, 201 bp, Homo sapiens
atgtgaggaacacctagacgtttttaaagccccaaaactaggatattgtgacacagaatgttttttattcagtgctgagatgggagtttatcccaagcgaytgtcctggcccctcatacaattatagtggtgaccagtcaggggctgtgggtgaggagacctgccagaggtggctggaggcactttattgccagcctggcg

SEQ ID NO: 4219 - DNA, 201 bp, Homo sapiens
gcttgtgcctgggaggtcaaggctgcagtgagctgtgattgcaccactgcactccaaactgggcaacagagcaagaccctgtctcaaaaaaaaaaaaaaaagggctgtacatctatacatatttctggtcacttctaagtattgcttttaagttactggcactagcaaaatctcaccaaacacaaaagtttaataatagaa

SEQ ID NO: 4220 - DNA, 201 bp, Homo sapiens
tatagatactaggcttatgatcttgttgagtaagtggtggcagtggaaataaaacatgggtaggttgagtggaagtcaaaatttgacacccaagtgttacraatttcaaactgttttagcaatgagtcaccatttctcaaactaatgattgtattagaactttactggctataacagaccaaagcagaattttattaatag

SEQ ID NO: 4221 - DNA, 201 bp, Homo sapiens
aagcaggcagatcatgaggtcaggagatcaagaccatcctgggcaacatggtgaaaccccgtctctactaaaaatacaaaaattagctgggcgtggtggcrtgtgcctgtaatcccagctacttgggaggctgaggctggagaattgcttgaaccagggagttggaggttgcagtgagccgagattgtgccactgcactcc

SEQ ID NO: 4222 - DNA, 201 bp, Homo sapiens
ctatccccaccccaatggtgcgttgggcagaagtactaaaatactttctaaatacttttaaataacaaagatttgaagtaattccttcttttttaagtgcyattgaaatgtcattgtgctccagagagaaatgcattgaatttatccacactatagtcttttgagttagagcaatacattctgttgtttatagatactagg

SEQ ID NO: 4223 - DNA, 201 bp, Homo sapiens
gcggtatctcacgcctgtaatcccagcactttgggaggccgaagcaggcagatcatgaggtcaggagatcaagaccatcctgggcaacatggtgaaacccygtctctactaaaaatacaaaaattagctgggcgtggtggcatgtgcctgtaatcccagctacttgggaggctgaggctggagaattgcttgaaccaggga

SEQ ID NO: 4224 - DNA, 201 bp, Homo sapiens
ctttgtcttactcttcctagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctcgcctaaggttaggaactgcgtgacaagta

SEQ ID NO: 4225 - DNA, 201 bp, Homo sapiens
cgtctgcgtctaccatcggccttcgtccctgatcgcaagttgggcaagaggtgtctgcccagttttatccactgacgtttagggctgactttaaaaggaaytctgtgtgtagttaaaaagtgctaagcattttccaaacactagtacctcatcatgaagcctctctgtaagtgtgtgtttgtcagcgaagatctgcagtgg

SEQ ID NO: 4226 - DNA, 201 bp, Homo sapiens
ttctagaaggcaatacatttgccctagagagtattagaataatgcctggtttttgaacctgctaatatcatgaaagatagtaaaatatttgtatgttggayattttttcaaacagaagaaagaaatgagacttgttgttcaaagtctttgtcttactcttcctagctggaaaacaggcttgggggagaagagaaattccag

SEQ ID NO: 4227 - DNA, 201 bp, Homo sapiens
atcgcttagcatgactgtgtgactcaggacccccgagtctgatttccatttagacaatctcaagctgtgacaatgggaaaatggacaaacattttttgcarctttaatgatttggggattctggctgtccccttcaggttacccgtttcctaaaactggttccagaccttttggccattgtgcagcgtaagaaaaaggaag

SEQ ID NO: 4228 - DNA, 201 bp, Homo sapiens
ttttttattttttattttttaaactgctcaaaagacagacatgatataagctgtcatggttaatgtattcatttgttttaactgggcctcactgagaacgygtcagagcatggctgtcctctggagcaaagagctcctctgagatgttctgctggagagaaaggggcgatgataaagggtatgagattccatttgagttct

SEQ ID NO: 4229 - DNA, 201 bp, Homo sapiens
cactgcatagcctaaacagcctgcaggtggtcacagatgtaggccccctagtaaactggcagggaagaacattgctatttgtcatccagtactagaggtcyggtcttttgtattaggcagaaatttgtgcctaagaaaattttgttttttacttacaggctatttgtaaagaatagcaatgccctatccccaccccaatgg

SEQ ID NO: 4230 - DNA, 201 bp, Homo sapiens; identical to SEQ ID NO: 947

SEQ ID NO: 4231 - DNA, 201 bp, Homo sapiens
ctggcagggaagaacattgctatttgtcatccagtactagaggtccggtcttttgtattaggcagaaatttgtgcctaagaaaattttgttttttacttayaggctatttgtaaagaatagcaatgccctatccccaccccaatggtgcgttgggcagaagtactaaaatactttctaaatacttttaaataacaaagatt

SEQ ID NO: 4232 - DNA, 201 bp, Homo sapiens
gaccctgaaaagtgctgcttgctgttgcagtttattttgaactgtttatacaaaatcttcctttttgatacccagcattttataagtaaagagagagcagragccttgatgatgcctctggtggatcaggtaaccaaacagaatcatctttcgttgctgaggaagccatcactgttcgagcttggcaggttttagatctgc

SEQ ID NO: 4233 - DNA, 201 bp, Homo sapiens
agtgcttggaagcaagattttagaggttcttaagtcctaagctaaggagggtgaattttttacttcattgttgtcagacagtgaagtgttgttttagcatsatgagcgaatgttataagtcacctcacttgggagaaagaataaagtaaatggccgttactgtcagttactggaagtaactttaaaacgcaaaaattaaga

SEQ ID NO: 4234 - DNA, 201 bp, Homo sapiens
tttagactcttctgatttagttattttaatagtgatttcaatgtaaacattggagattaaatggttaagttcagtgttttttcatttttactcttcccacrtctacagatgaagcattttttgactctgaaaatgaccctgaaaagtgctgcttgctgttgcagtttattttgaactgtttatacaaaatcttcctttttg

SEQ ID NO: 4235 - DNA, 201 bp, Homo sapiens
tgtttgccggccacttagtgaagccttttgctgacaccttgaaccaggtgaacatctccaaaacaggtgggtggtcgcttcagttcagctgtcacccttgycctgtgtgccttatacaaggtaccagtaagacacaacctagtgcttggaagcaagattttagaggttcttaagtcctaagctaaggagggtgaatttttt

SEQ ID NO: 4236 - DNA, 201 bp, Homo sapiens
cacctgataccatgcatcgcacagttttcggtggccatggcggatgactctctttggaaaccactgaactaccagattctgctaaagacgagagactcctygcctaaggttaggaactgcgtgacaagtactgaaactgcatcttttcactgcatagcctaaacagcctgcaggtggtcacagatgtaggccccctagtaa

SEQ ID NO: 4237 - DNA, 201 bp, Homo sapiens
gttgacattttacaacttggcagattgcattgctgaaaagctgaaagggctttttactctgtttgccggccacttagtgaagccttttgctgacaccttgraccaggtgaacatctccaaaacaggtgggtggtcgcttcagttcagctgtcacccttgccctgtgtgccttatacaaggtaccagtaagacacaacctag

SEQ ID NO: 4238 - DNA, 201 bp, Homo sapiens
tgtctgctcaacatctgccaaaaactatctccagatggtggcaaaatacccaaaggtaggtactttttggaaggaaaggttagaaaaattatctactttgrgcgtgagtgtacctgccacttagggtttttgtctttctcaccattgtagatattttagatgaggagaagttcaacgtggagttgatagttcagtgcatcc

SEQ ID NO: 4239 - DNA, 201 bp, Homo sapiens
taaaattaaatgtgttgtccctgtctaatcattaagtttattttaaatgaacttaacagtctcgtgtctcatggggctgcactgctgaaagaagctgttgsttcatctctgtttttcaagtgaaaattctatacaaaggaatatatttggacacgagtctatgaaaattccaaaatcatttgctcgtttattatatatatt

SEQ ID NO: 4240 - DNA, 201 bp, Homo sapiens
aacaggttgcattcagcccttagttgtccctggtatagtttaaattaataattgacaaatttcttgggtaaaggaccagataggaaatattttatgctttyggggccacacagtctctgttgcagctactcatctctgcagttgtatcaggaaagcagccacagacagggtgtaaacaaatgagcatggctgtgtttcagt

SEQ ID NO: 4241 - DNA, 201 bp, Homo sapiens
gttaatatctcatttatcctcaagtaatcctcaaagtaacctttaaccagtgacttcagaaaattaatttgatcataaactatgtcatttaaagaaatcaygtcccttttatgaaaaatatcatttaaacatttgtaaagagattgaagctattttcatattgaggatttgagtcagagctccttaacctggggttctcca

SEQ ID NO: 4242 - DNA, 201 bp, Homo sapiens
tatctcacttaaaaaccacaacattttatctctgttttacaaaggaagaaactagaggcttaaaagatttcagttatttgacaaagatcacaagctagtgrgtgtgacatggggagctgtgacagttctggaacatagagtcttaggcccaggaaataacagtaaatgttattattaagggaggggtggtggagcaagtag

SEQ ID NO: 4243 - DNA, 201 bp, Homo sapiens
ggtggtactgcaatgtgtaaactttgacttaaagaagaagatttagtttttaaaaatacacaccgctgaactctaggaatcatttgaaaatggcacatctytttcctgtgttattggtagaatcacatgggtccgtttatgagcatcttgcaagagcatattggggtgatgaagaaggaagagctcacctcccatcagtct

SEQ ID NO: 4244 - DNA, 201 bp, Homo sapiens
gttgatggaaggtaattcccaaactattcccaaccattaaacaattaaggaataattcagtaaaattctgtgaaaatgtgcccaatgataatgcagatttkgatataacgtgactagcagttgatccagtcctcatacaggcagctccagtctcaaatacaggcaggctcgagctcctgttttgagttgggtggagggagc

SEQ ID NO: 4245 - DNA, 201 bp, Homo sapiens
gtaaggaatactttttgcatttgatttttcattttatgtcttcagataacttatttattcagcaaatactaagttcagtacatagataagtaggttgccgytgattactgttttgaaataaatgccataataaaggattaagcagagttttgtggatatagttctgcctggaatagttgaagaaagcttcatggaaaaagt

SEQ ID NO: 4246 - DNA, 201 bp, Homo sapiens
tctcaaaggggttgataatccagaaacagttaagaatcattaatattttttctgtttttattgaaatatagttcagatgccataaaattcacccatttaargtatacaattaagtgattttagtatattcacgaagtttctgtaatcaccaccacgatctacttgaagagtattttcatcaccccagaaaagaaaccctac

SEQ ID NO: 4247 - DNA, 201 bp, Homo sapiens
gctaatgtgtttttgagcatttatacactaggccctggtaagcactttatctgcattatctcatttaattctcacagcattcctctggtgagattatttgyattatccttgttttacagttgagaaaactgaggcttagagggattaagtttcttgagtcacacagctagtaagtggcagagctaggatacagctgaagtt

SEQ ID NO: 4248 - DNA, 201 bp, Homo sapiens
acaccaaacaattaattcttagttgtctgctcaacatctgccaaaaactatctccagatggtggcaaaatacccaaaggtaggtactttttggaaggaaargttagaaaaattatctactttgagcgtgagtgtacctgccacttagggtttttgtctttctcaccattgtagatattttagatgaggagaagttcaacgt

SEQ ID NO: 4249 - DNA, 201 bp, Homo sapiens
tgtcctgaagatgtttagaacccttgccacaagagcagggaaatatggaatacaccaaacaattaattcttagttgtctgctcaacatctgccaaaaactrtctccagatggtggcaaaatacccaaaggtaggtactttttggaaggaaaggttagaaaaattatctactttgagcgtgagtgtacctgccacttagggt

SEQ ID NO: 4250 - DNA, 201 bp, Homo sapiens
acatgggtccgtttatgagcatcttgcaagagcatattggggtgatgaagaaggaagagctcacctcccatcagtctcagctaaccgcctttttcctggargccctggacttccgagcccagcactctgaggtaagctcaggttcactcctccaaatcctaaagctgttatccacctattgaagagtccgagaacaatcta

SEQ ID NO: 4251 - DNA, 201 bp, Homo sapiens
atcatgatccatgtcaagtctgtgtattgtattgagttgcagtatctgtttagtgtcttaatctggccctgatttctatgggctcatgaattctttattcygtggattctaatccatatgctgccattatatatttgggtgcaggaattttcctttctctcccatgtcctcggggtttgcctcctggccttgctgtgtacc

SEQ ID NO: 4252 - DNA, 201 bp, Homo sapiens
tgaactctaggaatcatttgaaaatggcacatctctttcctgtgttattggtagaatcacatgggtccgtttatgagcatcttgcaagagcatattggggygatgaagaaggaagagctcacctcccatcagtctcagctaaccgcctttttcctggaagccctggacttccgagcccagcactctgaggtaagctcaggt

SEQ ID NO: 4253 - DNA, 201 bp, Homo sapiens
gaaatcttatatcttatttctagacttgatgtttaatgatagtattttagttattccttattgaatgagttccttattgaatgagttctggacaatggccrttaatgtaacaatgaattgtacaacttttacatttcccatcatttctcttttgggtgtcctgaagatgtttagaacccttgccacaagagcagggaaata

SEQ ID NO: 4254 - DNA, 201 bp, Homo sapiens
taattatcccaacactctcctttacaccgcatgtgtttctgcatcatgatccatgtcaagtctgtgtattgtattgagttgcagtatctgtttagtgtctyaatctggccctgatttctatgggctcatgaattctttattctgtggattctaatccatatgctgccattatatatttgggtgcaggaattttcctttctc

SEQ ID NO: 4255 - DNA, 201 bp, Homo sapiens
aattatctactttgagcgtgagtgtacctgccacttagggtttttgtctttctcaccattgtagatattttagatgaggagaagttcaacgtggagttgayagttcagtgcatccgcctttcggagatgccgcagacccatcaccatgcccttttacttttgggcactgttgctggaatatttccggtaagcgttaatgat

SEQ ID NO: 4256 - DNA, 201 bp, Homo sapiens
cctaaggcatcttgcaaagcagaatttttgtattgcacgtcagcggtttcctgtcaacacgctaggggccagtggtatttatgattgaagatgctcaagartgttgagacctggctgttccattgtgttgatcatttgccatttacaaggttaggagccttcattaccatggggcaaatgattaaaccgcttcacttacac

SEQ ID NO: 4257 - DNA, 201 bp, Homo sapiens
aaccacagtacattgatcaaattcagaaaatttaacattgatccaatccagtgatgtaatctacagttcatactccagtctccctaattatcccaacactstcctttacaccgcatgtgtttctgcatcatgatccatgtcaagtctgtgtattgtattgagttgcagtatctgtttagtgtcttaatctggccctgattt

SEQ ID NO: 4258 - DNA, 201 bp, Homo sapiens
tttatccctttcaggttcgatttgctgctttgattactgtgttagcactggctgaaaaactaaaggagaattatattgtcttgctaccagaatccattccyttcttagcagagttgatggaaggtaattcccaaactattcccaaccattaaacaattaaggaataattcagtaaaattctgtgaaaatgtgcccaatgat

SEQ ID NO: 4259 - DNA, 201 bp, Homo sapiens
ctggcttttttttcttctgtgagatctttggagttgggctggtagagccgccttttattacttgtggaaattgatgggccctgtttctactgtgagaggtwtaatcctaaggcatcttgcaaagcagaatttttgtattgcacgtcagcggtttcctgtcaacacgctaggggccagtggtatttatgattgaagatgctc

SEQ ID NO: 4260 - DNA, 201 bp, Homo sapiens
ctgcatcccagcctgaatgacggagcgagacgctatctcttgaaaaaaaaattagtagaaattaacagaaataaaaaatgttgatagttgtgttttctttyaggataaagttttacacaatatcatgtctatttttacatttatgggagccaatgtcatgcgcctagatgatacttacagttttcaagttattaacaagac

SEQ ID NO: 4261 - DNA, 201 bp, Homo sapiens
aagcagattacagtagtgtttttaattaacctcatacatttatatgattgaagttttggtccccagattgtatggaaatgcctagtggcattaaggatgcrgtaggatgtccacttttagtagcaaccgatgttcattcactactccatgttaggtgctttacttggattatctcacttaaaaaccacaacattttatctc

SEQ ID NO: 4262 - DNA, 201 bp, Homo sapiens
tgttattttttaaattactgttgtgtccgtactgttagcactgggagatttcttgtgcttagccacataaaatgtatagacactgctttttaggctatgargcagatagcgatgtaataggcacagtttgctggtttttttcataatgccctctactccattccctagcctctgtttctgcttcaagttcttctaaagctc

SEQ ID NO: 4263 - DNA, 201 bp, Homo sapiens
cagaaaaggaaaaaaaattagctgggcagggtagcatgcacctgtagtcctagctactcaggaggctgaggtggaaggattgcttgagcttaggagtccarggtttcagtgaactgtgatcacacaactgcactgcatcccagcctgaatgacggagcgagacgctatctcttgaaaaaaaaattagtagaaattaacaga

SEQ ID NO: 4264 - DNA, 201 bp, Homo sapiens; identical to SEQ ID NO: 933

SEQ ID NO: 4265 - DNA, 201 bp, Homo sapiens
tgtagggcagtgcttgcaaggagttttgcatagtgcctgacacatagtaagtgttcagttaatgaaagacattgttattttttaaattactgttgtgtccrtactgttagcactgggagatttcttgtgcttagccacataaaatgtatagacactgctttttaggctatgaagcagatagcgatgtaataggcacagttt

SEQ ID NO: 4266 - DNA, 201 bp, Homo sapiens
acctgaaaggttattttaagaattaaataagaaaatgtgtgtggaagtgcctggtgcctggaggtgtgcagtggacagcagtctgtcttaattgaagttgrttttttttttaatttgtttttcttttcatgttaaatataaaatttctctttaggtcaatgccttgctgcccacagagacattcattcctgtgatcagagg

SEQ ID NO: 4267 - DNA, 201 bp, Homo sapiens
gggtgggaagataaggaaaatggtgatttctcacacagattttatgatattgtccagtttaaacatggggctgatgatgcctaatgtgtgttatttagaayctttttgctcagaacctttttcaaaaaggtttttggcattttaaaaaattgcattcagagcccatagcactctgaatatcctcagttgcagcaaaacatc

SEQ ID NO: 4268 - DNA, 201 bp, Homo sapiens
ttccgagtagtttttgaaataatttagtacagaattatttaactcgtctttctacttgaaacatttagcataaggtagacatgaacaagttctctgagtgycttcagctgccgtttgctgagcgagcctctgtgtttcaggttgctggagaccgttctcggctatatcagtgcagttgcacagtccatggaaaggaacgca

SEQ ID NO: 4269 - DNA, 201 bp, Homo sapiens
gccttaaattatttgtttctttataattgtacactagtgagaagaggatttggaaccagcttatttgagtaagaattaaaagtttgcttttttttttttttaattaggtgcatctagaagatgtttttcagttattcaagttctgttctgttttatggacctatggttctagcctttcaaatccactaaactgcagtgtga

SEQ ID NO: 4270 - DNA, 201 bp, Homo sapiens
gaggtcgatgcttctgcacagaagcgcctagttacttcttgatgatctctgtctatggcaataatccctcatttcctttctttccgagtagtttttgaaayaatttagtacagaattatttaactcgtctttctacttgaaacatttagcataaggtagacatgaacaagttctctgagtgccttcagctgccgtttgctg

SEQ ID NO: 4271 - DNA, 201 bp, Homo sapiens
tttccgagtagtttttgaaataatttagtacagaattatttaactcgtctttctacttgaaacatttagcataaggtagacatgaacaagttctctgagtkccttcagctgccgtttgctgagcgagcctctgtgtttcaggttgctggagaccgttctcggctatatcagtgcagttgcacagtccatggaaaggaacgc

SEQ ID NO: 4272 - DNA, 201 bp, Homo sapiens
ataaggtagacatgaacaagttctctgagtgccttcagctgccgtttgctgagcgagcctctgtgtttcaggttgctggagaccgttctcggctatatcartgcagttgcacagtccatggaaaggaacgcagacaaactcaccgtgaagttctggcgcgcgctccttagtaaagcttacgacctgttagataaggtaggt

SEQ ID NO: 4273 - DNA, 201 bp, Homo sapiens
aaaataataaataaataaaaagatactgtgggttatttgggttatgacagtttataatgtaaacaaaagtagacttgtaaacagtgaagagtatataatadcacgggccctgtaaaagagtacaatcacaatactaatcggtaggttgaatagaaactaacattgctacactcctactaatatgttaggcccattactata

SEQ ID NO: 4274 - DNA, 201 bp, Homo sapiens
ccagggccactgtcctgccccttccactggaaagtgcctgccctgcagccaggaatgtgagctgctgagttccagtcctgtgggctgacttgtagcgctaygcgtaggactttcgtttttggagctgattttgtctgcgcccccttctcccctcctctgctgtgcggtgtcaacttctgtctccactcttccctctagctc

SEQ ID NO: 4275 - DNA, 201 bp, Homo sapiens
gtactccagcctgggtgacaagagtgagactctgtctcaaaaaaaaaagatgggctgggcgcagtagctcacgcctataatccgagcactttgggaggccraggtgggtggatcacgaggtcaggagatcgagaccatcctggctaacatggtgaaacgccgtctctacgaaaaatacaaaaaaaattagccgggtgtggt

SEQ ID NO: 4276 - DNA, 201 bp, Homo sapiens
gcaaagcgctggaccttttgaataacaagctgcagcaaaatatatcctggaagaagacaatagtgagtgaagacccaggacacacccatttactgtacttygctttatcaaagagctgcatttaactcccttcaatttctctagtggtacaatttcaaattgaagtatattattatctgaatataataccatgacatgttt

SEQ ID NO: 4277 - DNA, 201 bp, Homo sapiens
cgcttgaacccgggaggcagaggttgcagtgagccgagatcacaccaccgtactccagcctgggtgacaagagtgagactctgtctcaaaaaaaaaagatrggctgggcgcagtagctcacgcctataatccgagcactttgggaggccaaggtgggtggatcacgaggtcaggagatcgagaccatcctggctaacatgg

SEQ ID NO: 4278 - DNA, 201 bp, Homo sapiens
actccatttctactaaaaatacaaaaattagccaggcatggtgatggggcctgtaatcccagccacttgggaggcagaggcaggagaattcgcttgaaccygggaggcagaggttgcagtgagccgagatcacaccaccgtactccagcctgggtgacaagagtgagactctgtctcaaaaaaaaaagatgggctgggcgc

SEQ ID NO: 4279 - DNA, 201 bp, Homo sapiens
ttgaacctgggaagcggaggttgcagtgagctgagattgtgccgctgcactccagcctgggtgacagagcaagactccgtctcaaaaaaaaaaaaaaaaaaagaaatatgcctatttattcctaccctttattggataaacagttcatatgaataaagtttgtttttagagataatgtttcaaggtaagacatagataaaa

SEQ ID NO: 4280 - DNA, 201 bp, Homo sapiens
agttcgagaccaacctggccaaaatggtgaaacctaatctctactaaagatacaaaaattagccaggcatgatggcgggcacctgtaatccttcctactcsggaggctgaagcagtagaattgcttgaacctgggaagcggaggttgcagtgagctgagattgtgccgctgcactccagcctgggtgacagagcaagactc

SEQ ID NO: 4281 - DNA, 201 bp, Homo sapiens
cttttcgtatgaattttttctttgaagaaatgtcttttcaaatcctttgcctgttttttaatcaggttatttctctttttattggtgagttgtaatgaatygttgaaatggaaaatgttagcctgagcaggaatatcacttgtggccaggagttcaagaccagcctgggagttcaagaccagcctgggtaacatagtgaga

SEQ ID NO: 4282 - DNA, 201 bp, Homo sapiens
tttattatacatatgtagataacaggttattttatattgctttacttttaatacctttctcgaggtcatgagcatgttttcgcctgtagcagcacgttgasttaatcaaatccctcactggagacgttacattgtaaatctggctttggattattttccttctaagttattactctgtactgcttgtacagagtcatattt

SEQ ID NO: 4283 - DNA, 201 bp, Homo sapiens
ttgcatataaatgacattaaaagccttttttttagttttttttttttgttttttttttttaatatcctcaacagttgtataaaagcctttctgaaatgctsaagtacattgcccttaagttttagaacattgaagctaagaagcagtcttggcaatgtctttctcaataatataaacaaacgtgttatagctggttctgct

SEQ ID NO: 4284 - DNA, 201 bp, Homo sapiens
caggcggactgactcagattttaattttgattttttttttttttttttagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttt

SEQ ID NO: 4285 - DNA, 201 bp, Homo sapiens
atggtaagtatgctttgaaagtccaccccctggatttctttctcatactcttattaaattctcagcttttgctttactagatttttcttaaaaaaaatttyttttattcttgagtacttggttttactttaaacgttgcagtgttgtttaatatattctgtgcaatgtttgaaatcttttaacattttatatattttttca

SEQ ID NO: 4286 - DNA, 201 bp, Homo sapiens
aacgtgccgaactctagaacttgtgtcatagcaattagaagcagattcttactacaagtaaaatcatatgatcagtaaaatttaatttcagctaattacarctaatcacactaagttcatcttcatttgaattttattggttttatagagtttttagtatttcccttgtagatttaaaaaaaaatttttgttttatgtcat

SEQ ID NO: 4287 - DNA, 201 bp, Homo sapiens; identical to SEQ ID NO: 943

SEQ ID NO: 4288 - DNA, 201 bp, Homo sapiens
gttcaacttgttgatacactgggtgcagagaaattcctctggattctcctcatcttgctttttgaacagtatgtcacaaaaacagtgctggcggctgcctrtggcgaaaaggtcagaacctagggtgggaagataaggaaaatggtgatttctcacacagattttatgatattgtccagtttaaacatggggctgatgatg

SEQ ID NO: 4289 - DNA, 201 bp, Homo sapiens
aatagtatgagaaaaggcatgatctaggaatgtgcacagcatgtttgaagaatgtaatggtgattgattgatggagagcagagggttgagacaggtagacrttggtttattcattcattcaagtgttttctgtcattctttctgtcatttattcaacaactatattttgatcaccaatacctggagtaaaatggttcaaac

SEQ ID NO: 4290 - DNA, 201 bp, Homo sapiens
aaagtgctggaactacaggcgtgagccaccgtgcccggctgcttagcataatgtttttgaggttcattcttgttgaagcttgaatccgtattccttttatractgaataatattgttgtatgtgtatgccacattttgtttatctgttcatcggttgatggacatttgggttgtttcaactgtggggctattataaattat

SEQ ID NO: 4291 - DNA, 201 bp, Homo sapiens
acggggtttcaccgtgttagccaggatggtctcgatctcctgatgtcatgatccgcccgcctcggcctcccaaagtgctggaactacaggcgtgagccacygtgcccggctgcttagcataatgtttttgaggttcattcttgttgaagcttgaatccgtattccttttatgactgaataatattgttgtatgtgtatgcc

SEQ ID NO: 4292 - DNA, 201 bp, Homo sapiens; identical to SEQ ID NO: 951

SEQ ID NO: 4293 - DNA, 201 bp, Homo sapiens
cagctaattacaactaatcacactaagttcatcttcatttgaattttattggttttatagagtttttagtatttcccttgtagatttaaaaaaaaatttttgttttatgtcatctatattttaagaaggagttatacttaattttaagttgatatataaacaacaaacaacatttagatctttgagaatgtttctttgaaa

SEQ ID NO: 4294 - DNA, 201 bp, Homo sapiens
gcagtaaatctgtttttgtgcatgtgtgtatatgtcttattccttcctagctgattagaatatacatatctgatccggcacttggaaacaatcggtatggwtgattctgtattgcattactagttgtccactctaagggatgagcgtgaaattgagtgactctggactggagaagtgatactgtatcataatcaagacaag

SEQ ID NO: 4295 - DNA, 201 bp, Homo sapiens
acagcagctcatgcctataatcccagcactctgtgagaaggatcacttgagcccaaacgtttgagaccaacctgggcaacatagggagacccccttctctrtaaaaaagttcaaaaaataaaaaattagccaagtttggtggcacacgctttggtcccagctacttgagaggctgaggtaggaggatctcttgggtgtgag

SEQ ID NO: 4296 - DNA, 201 bp, Homo sapiens
aaattactttgtagaattacttgactaaattaaacctacacatagacacaagtatacatgaaatcataccattaacaatacaaattttttcatcaactcatgtgatgttctagaaacaaagattttgcatttttttgtttgttttctgtagttagatggttgttactgaaaatgttgggcaatttggggtggttttctctg

SEQ ID NO: 4297 - DNA, 201 bp, Homo sapiens
aaaattactttgtagaattacttgactaaattaaacctacacatagacacaagtatacatgaaatcataccattaacaatacaaattttttcatcaactcatgtgatgttctagaaacaaagattttgcatttttttgtttgttttctgtagttagatggttgttactgaaaatgttgggcaatttggggtggttttctct

SEQ ID NO: 4298 - DNA, 201 bp, Homo sapiens
cactgggaggccctgcactgagctctccctgtgctcctcgcccccatgaaggcttcagaagaaagaggggcagctcagccttgctgctaacccggccccamcccgagaggccagaatgaagcacaaaacctgaatctgcaaagcagcaagttgagggtttccattcttttgataggagcagtggaaaggactgtcaaggaa

SEQ ID NO: 4299 - DNA, 201 bp, Homo sapiens
tttctagtaagccttacccttgcttatggttaagttctttgccctatctctctccactcataggatctcttggaaccatcctataaaactacccccattgrcctatcatttattacttagaaaagctcagtagtggtgtcaataagcttttgtcaagaggctagccggctcactaattagaccttgcaacactggttcttt

SEQ ID NO: 4300 - DNA, 201 bp, Homo sapiens
tgacctatcatttattacttagaaaagctcagtagtggtgtcaataagcttttgtcaagaggctagccggctcactaattagaccttgcaacactggttckttttagcttagcatggctgcttaggaatccctagtctccgcgtcaaagactacaacttcaaagactggattttataaaatcacagaagatgatcggccct

SEQ ID NO: 4301 - DNA, 201 bp, Homo sapiens
ttctctcagtgccttgcaaacagcagctctagtgtatattgagaaaaggaaaaattctgaatggcaaatactagatttcaactttaacctattcctttttattattattattattattattattattattattattattattattgagacaaagtctcgctctgttgcccaggctggagtgcagtggcgcgatctaggctc

SEQ ID NO: 4302 - DNA, 201 bp, Homo sapiens
gggaatttcctaaactactctttaaaatattaattcctattttatgtattgtttttgtgatacataatgatatgaaactaatgccaggagaaatttccatkttgttattctaaagcagacaaaatgggatatgaaagggaaaaatgttaattatagacttcaacattctatgttggacctcgtagttgttctggtcagaag

SEQ ID NO: 4303 - DNA, 201 bp, Homo sapiens
tgaggtgggagaatcgattgagtctaggaggtcgaggctgcagtgagccatgattgtgccactgcactccagcctgggtgacagaacgagaccctgtctcaaaaaaaaaaaaaaaagttgttatactgtatttttttatttgtcttattttttatcattgttttatttatttattttagagacagagtcttgctgtcaccc

SEQ ID NO: 4304 - DNA, 201 bp, Homo sapiens
aaagcagtcaggaggctgctgcaaaatccggacataccatgaggagggcctgtaagagtgaagtggaagggcagatgtggacgatgctctgaagcagagartgatgctcaaagtgtggtccgtggcttgatgctgccccacaagtgttagttacagacctggcacacagtaagggtagatttgagggtaagtctttaaaac

SEQ ID NO: 4305 - DNA, 201 bp, Homo sapiens
ttagtagagatgggttttcaccatgttggccaggatggtcttgatctcctgacctcgtgatctgcccgcctctgcctcccaaagtgctgggattacaggcrtgagccaccgcgcccggctttgtagctcagtttttaatgacagggtttggctttgattctgatgtctgcacaacgctcccagggctgtaagaactgcaga

SEQ ID NO: 4306 - DNA, 201 bp, Homo sapiens
ctgctttctcaccttcttttcatcctctaattcatacctgcaatccttattagaaatcctgtcaacttaatagtaccagaaagtcaggcaaaagactgataaaaaaaaagcctcggtggtcaagaacttaaaattacactactggtgtgcaacgtgctcttatctgtgttactggaggacaccctcaagatacctcactcc

SEQ ID NO: 4307 - DNA, 201 bp, Homo sapiens
atgatgggacagattacttctgaagaccccttatgtcctataaatctcatagttctcaacaagagggaaacgggaacaacaggggcagaaaccaacgagabgctgaggaaaccaaaccaatgagttttggattgtagctaaccgaggagaaccaggtgtgtcaaaggtgatgaaagtcagatgtgtaaaaagcaagaagga

SEQ ID NO: 4308 - DNA, 201 bp, Homo sapiens
ggtggatcacctgaggccaggagttcaagaccagcctggccaacatggtgaaaccccgtctatactaaaaaataaaaaaatttaaaaaaaattgccgggcrtggtggtgggtgcctgtaatcccagctactctggaggctgaggagaatcacttgaacccaggaggtggaggttgcagtgagcctagattgcgccattgca

SEQ ID NO: 4309 - DNA, 201 bp, Homo sapiens
ggctgaggagaatcacttgaacccaggaggtggaggttgcagtgagcctagattgcgccattgcactccagcctgggcaacaggagcaaaactccatctcaaaaaaaaaaaaaaaaaaaaatgaaatggtttggcatgatggtggggtgctgattcctctctctgtccttgagtatttactgccaggaaatcctgaccaac

SEQ ID NO: 4310 - DNA, 201 bp, Homo sapiens
gctgaggagaatcacttgaacccaggaggtggaggttgcagtgagcctagattgcgccattgcactccagcctgggcaacaggagcaaaactccatctcaaaaaaaaaaaaaaaaaaaaatgaaatggtttggcatgatggtggggtgctgattcctctctctgtccttgagtatttactgccaggaaatcctgaccaaca

SEQ ID NO: 4311 - DNA, 201 bp, Homo sapiens
ttacctagcttgcaaagttgtaattccaactgcgtctcactcagctggcagtgtgcacccttggccacacattagaatcacccaagagctattaaaaatcytgaaggtcataccccaggcaagtgaatcagaatctctagggatgggtcccaggcattcgtttgcttttttagtctccccagataattttaatatgtagcc

SEQ ID NO: 4312 - DNA, 201 bp, Homo sapiens
atcagaatctctagggatgggtcccaggcattcgtttgcttttttagtctccccagataattttaatatgtagccaaaattgataatccctgcactagacsaagctccgattcaaatttaaatattaagaggacacatgtataactttgctgaataattttttcctatcggtaggatggtgggaaggaattgctataggcc

SEQ ID NO: 4313 - DNA, 201 bp, Homo sapiens
taagacaatcaaaagtcaaaatagagtttaaacaggggagtgacataacctgatttgcatcatgctggctgtagtatgcagaattgattggagaggcaagratggcagacaggacgccaggtgggaagctatggaaaggtgcatatggaagaagagagtgtctttggattccagttggtaagtggaagagactgaagcatg

SEQ ID NO: 4314 - DNA, 201 bp, Homo sapiens
aaaagtattttttaaaaataaataaaaatagcaatacaataattaaaaatagaaaatgtaaaatacggtataaacaactatttacatagcattacattgtrttagttattatacataatctagagatgatttaaagtatatgggagaatgtgcataggttatgttcaaatactatgctattttagattagggacttgagca

SEQ ID NO: 4315 - DNA, 201 bp, Homo sapiens
tattagagctctgaatactctgcaaataatatgtgagcactggtaccatcaaagcatgtgttgccttaggtggtgtttacagaccttgtcagagttggtastaattccagaatataatcatttcaatagctaaggcttatggttaagacttccaaagtgttcagaatttactaaattgaattatttgaggttttgttactg

SEQ ID NO: 4316 - DNA, 201 bp, Homo sapiens
ttttatctctgttatcctaccatctaggtcaatacattttaacatctttatttgctgtaagtttatttctaattttttattctttattttgtttattcccrtacttaacttttacttacgactacggatttaagtagcatgaactgtcttcagactggcctcctgtgatgagtcacaaggcccatcataatggatccagat

SEQ ID NO: 4317 - DNA, 201 bp, Homo sapiens
ctgaattgatgattcaagaacttttagaatcttagttttatttttgagtagcaaataacattatactgtagatataaaaaatgttgaagattatcccaggragtgctctggaagctgcttttaaaaataaataacttttaaactgccttttctcccttagcatttgcccatttgttctaaaggtagaagaacaactttcag

SEQ ID NO: 4318 - DNA, 201 bp, Homo sapiens
agaaaataaaatccattttctcagaatgatgagaaattttacaccttgaagagaccatctcttttccaaactgagatccacagattcttggagatccacaratatattcttgggctctgagagttttagaattttaaaataatctgtttttatatcaataatctaaaaggtcattagaaagcccacatttcacaatacaag

SEQ ID NO: 4319 - DNA, 201 bp, Homo sapiens
ctgccaaggagacagacaaagtaaatggaatgacctgggttagacaggtttggacgaattttgaaacaaaggacacagttggatgggtgccctgtccttargagcacagacttttttctggatgtcattgagacctagaatgacctttaactatcaccagtacacattcccctttttggtgtgcagtgttgacactgaaac

SEQ ID NO: 4320 - DNA, 201 bp, Homo sapiens
actttccatgattgttttttctcaatttttagaacagtaggaattcttcacctcatctgctatcccaacatattcacaattggaaaatttttgtgctgttmtgttcttttcaaattacaaaagtccttgactaggactgctggcttttacatgcacaggactgcacaacactggtgtttataaagctcattcgttcaatga

SEQ ID NO: 4321 - DNA, 201 bp, Homo sapiens
tttatctactattttaaggcacattttatttttaataaaatttgaaaatatattaatatttaatttatttcaaatatttttcctaagcatactatatatcycatgtctattcttttcacttagtcaatttcccatgtcattacatactctttgttaatagtttttgttaactttttaaataaaagtattacatggtcattt

SEQ ID NO: 4322 - DNA, 201 bp, Homo sapiens
acagaaatgttatgttgctctttatgagacgaaataaagttggatgtcacttataaatggattttgattgatttttttaaagtattgactcactaatcttyaaattggtagaaggaggtcagtagactttgactcataaatttttgtaagcgtaatggcttgttgaataactcctaattgtctttaacaaccttggtttct

SEQ ID NO: 4323 - DNA, 201 bp, Homo sapiens
acacaacatagaaataaatttagttatttagcaatttgttgtatttttggccctgcaagtagtacatgatctgactaaccaattccaaaagccagattttyttctgagtgtgacttttttcttttttttttcttttttttttttcctttttttttttttttttttttttgtgagacagggcctcactctgtcacccagact

SEQ ID NO: 4324 - DNA, 201 bp, Homo sapiens
ttttgacatgaaaaatgaaatgtgaagtatttggaattcaaccctgaatttttttgccggtaactcttgtgtatgttcaactaatttagcaaactgcactrgttcacattttttaggtgaaacaagaaataacagaagttgcacctaaagtagtcaaatttcgtagagacagaaagtggaatggtgcttaccaggggctgc

SEQ ID NO: 4325 - DNA, 201 bp, Homo sapiens
agttcacattttttaggtgaaacaagaaataacagaagttgcacctaaagtagtcaaatttcgtagagacagaaagtggaatggtgcttaccaggggctgsggcactggaaaggaacggggagttagtgtttaatggggacagtttcagttttgcaagatgaaagcatcctggagaatggttacacaacattgtgagtgta

SEQ ID NO: 4326 - DNA, 201 bp, Homo sapiens
tagtttcatttgagatctgagaggatttcatctaaaacggaaaagttattacctgtgaaggagaacaaaggaaaaggaaaaagaaattttaagaaaaaaawatttttttaaacctgtagttactttatgttcaagtgggtattttcaacgctgagttgctgaaatggttttttattgaaagaaggttaaaagtgtatttca

SEQ ID NO: 4327 - DNA, 201 bp, Homo sapiens
gaaataacagaagttgcacctaaagtagtcaaatttcgtagagacagaaagtggaatggtgcttaccaggggctgcggcactggaaaggaacggggagttrgtgtttaatggggacagtttcagttttgcaagatgaaagcatcctggagaatggttacacaacattgtgagtgtacttaatgccattgaatgcacactta

SEQ ID NO: 4328 - DNA, 201 bp, Homo sapiens
ctattaagtttcgtgagcccgtgatttcaacagtacgtaaatttcctttagtacagtcacagaactggtaagtgacaccagctgaaactgagtgcagctcygcggctctacgcttgctgtagaacctttgtgaattcccactgtgcttcaccagtgacaggatgtgctacccaataaatctccatataactgatcttgaaa

SEQ ID NO: 4329 - DNA, 201 bp, Homo sapiens
caagtcttcagcagttatattccacttcattgccagggtgtctggctctaaggggaatctctgcttagaggaccattaatccttaggaacctttttttttwtaaaaaatctaaagatggttcctggacatcatttaccaactggcagtttaaatggcctgtgtaccataaattgtgaggttaaaaaaaatctggtacacag

SEQ ID NO: 4330 - DNA, 201 bp, Homo sapiens
cctcttcgatgtcatcacctccacctgctcccacaaatcttatgggtcagacacaccaggctgctcagtgtcctctcacagtgctgagtttatgactgggrtggattgattttcatactattgttgattcaacattttttatagtatacttcttgagaacagagaccatgttcagggatccctagtgcttaatacaattcc

SEQ ID NO: 4331 - DNA, 201 bp, Homo sapiens
aggattgctgaaaaggaaagagccctaaagcaaactatctacagttttggttagttttcttttcttttcttttctttttttttttttttttttgaggtggrgtcttgctttgttgcccaggtgggagtgtcttcttatattggtcaggctggccttgaactcggggctcaagccgtcctcccacctcagcctcccaaagag

SEQ ID NO: 4332 - DNA, 201 bp, Homo sapiens
gtgtcctctcacagtgctgagtttatgactgggatggattgattttcatactattgttgattcaacattttttatagtatacttcttgagaacagagaccrtgttcagggatccctagtgcttaatacaattcctaccaaatattatgcaagtaataaaattgcagtgtcattgaacattttcagatatgcatttatttct

SEQ ID NO: 4333 - DNA, 201 bp, Homo sapiens
gcaggttttctggcctctagttcagagcattcgtagcatgctagcccctcagtagcatagtactttaggaagctagtctttcccacttgctggtagtaagmcagggagacataatacactaagaaagcttcggtctgagaaaactttccatgattgttttttctcaatttttagaacagtaggaattcttcacctcatctg

SEQ ID NO: 4334 - DNA, 201 bp, Homo sapiens
aggtgatggactgattgatatgcttcagaaatatgttttttcctgcaagtaatgaaaataaacacacgttcttaattattttggtcatttaacaacccatsatttctggaccatgggttaattccaccgattgctcagaagccttcctgagtcatctcaagcacaatcaattcactactgtgtctagacactgcccttaga

SEQ ID NO: 4335 - DNA, 201 bp, Homo sapiens
ctttgctgaattggatcagaaaagtaccctcaaattcccagcatcatttcttcaaggaagtagtgaattggggcaccgtgggttttttgttttgttattgktcttaaaccaccttgcctatgtgcactcaactacaggaacgagaacttgcctgaaaccccaaacgtgtctgcatcaggcattatttttcttgagctcctg

SEQ ID NO: 4336 - DNA, 201 bp, Homo sapiens
tttggacaaattagcaaacccaagttttgctttaacttggattgccttaataaagatgttttggggcttaatggcacagttgctcaactcccccactttaktccgtgatgttcagacccagccagcatttccccatcaggctcttgcaccatgattgacagggacacttttactagtccccttgaagaatgaatagttact

SEQ ID NO: 4337 - DNA, 201 bp, Homo sapiens
ccattaggaaaaaattgcttttctaggtgtgtaaagttttgcatatgattatagcctcttacctgtaaaaactgaatcagagcttagaaccatgcctggtkcacaatagtcattcaacaattattccttgaataaagagacagtattgtgtggtctgtgaaataacaaaagttcaggagcaacagacacttggtgattcta

SEQ ID NO: 4338 - DNA, 201 bp, Homo sapiens
actttgaggggctgaggagggcaaatctcttgagcccagcattcaagagcagcctggaaaatgtagagattctgtctctaccaaaaaaaaaaaaaaaaaaraagaagcaggtggaggaaggaggagctgcagaaaggctccgggagccagtgtctagtaagcagaggcctagcccaggctgagtggtcccagcccaggagg

SEQ ID NO: 4339 - DNA, 201 bp, Homo sapiens
cactctgagaccactctgccatctcacattgttctcttgagccttatctcaatggataaaggtcactagagtttattagacacaggaaaacatcgtttacrgacttcttcattgtgtagggattctgccttcaggcctgttcaccagccaggagaattgtgctttttgatccagggctcttggccagaacagccttctcgc

SEQ ID NO: 4340 - DNA, 201 bp, Homo sapiens
ctataaagtatttgagaataaatctaacaagatctacataaagaaaaaagtaaactgcttaaaagtaatttaagttcaccatttgcaaattgaactaaagaaaaatctaaagaagaactagtgaaaattgcttgcaatcttaccactgaaaagaaacctctgttaaaatgtatcagtattttaaaactgtgttttgtcctt

SEQ ID NO: 4341 - DNA, 201 bp, Homo sapiens
tgaggcaggagaatagcttgatcccgggaggcataggttgtagtgagccgacgtcatgccactgcactccagcctggatgacagagcaagactccatctcaaaaaaaaaaaaaaagaaaagaaaagaaaaggagatttctgagtagaaacacgttagcagaggaaacttcatttggggaacaggattgttttgatgccatg

SEQ ID NO: 4342 - DNA, 201 bp, Homo sapiens; identical to SEQ ID NO: 1110
  misc_feature (1)...(201): n = A,T,C or G, or insertion/deletion polymorphism (see Tables 1-2)

SEQ ID NO: 4343 - DNA, 201 bp, Homo sapiens
gcctcccaaagtgctgggattacaggcatgagccaccgcgcccggctttgtagctcagtttttaatgacagggtttggctttgattctgatgtctgcacarcgctcccagggctgtaagaactgcagaacacactgagaagacaccgtcccagccatggaaagcccttctatgcagtcatttattttcacatgaacacctc

SEQ ID NO: 4344 - DNA, 201 bp, Homo sapiens
ggacaggtggaaggactgcatctgtgtgttgccaaagagtaacagagactggtataggacttgagttcaattcagtcatatccttaagtattgtgccatcrtgtctggattactttgtagtataagtaaatttccaagcatggggaggaaaggagaagctcctttattgagaattcaactgaatatagagaaaactaattt

SEQ ID NO: 4345 - DNA, 201 bp, Homo sapiens
taagccccctgagcctatcaccctcttttaggatccatctcctttctcggcatcaaaataactggccacagcaatattcattcaagcagccttgctttccyctgggaagaacccgacctaggtttagaaaaggtattgaatcccactatttcacctttcaggagaactaccagagttacctcttttttttttttttttttt

SEQ ID NO: 4346 - DNA, 201 bp, Homo sapiens
aagctccgattcaaatttaaatattaagaggacacatgtataactttgctgaataattttttcctatcggtaggatggtgggaaggaattgctataggccrcaccatgatactttgctgaattggatcagaaaagtaccctcaaattcccagcatcatttcttcaaggaagtagtgaattggggcaccgtgggttttttgt

SEQ ID NO: 4347 - DNA, 201 bp, Homo sapiens
aaagaacatgtctagaatgcagtgcaacaaatatcaacaaataggttaactgagaggcaagtactgtttgtggtaagggatggttatgtgattcaagttarttttcattctgtgctaatctctaattttatgctttgaatttactctgagtttaatttttttgagtctcaatttcctctaaaagaatgatccagtactttt

SEQ ID NO: 4348 - DNA, 201 bp, Homo sapiens
ctgccttcagcccagtccaggacaccgtctgtgcctggctgctagtctcttgatggggttttcagcttccatcctaacctcacaacagcctagtctcaacyggtcacccacagagatgatgctcaaatgtgagtcagatccgtcactccacccatagccctgcagtggttccccatttcacttgtaacaaaagtccaagtc

SEQ ID NO: 4349 - DNA, 201 bp, Homo sapiens
gtttttgagaatagtgtaagaatgtattggtcatcctaactttaatgaatgaacttaagccccctgagcctatcaccctcttttaggatccatctcctttytcggcatcaaaataactggccacagcaatattcattcaagcagccttgctttcctctgggaagaacccgacctaggtttagaaaaggtattgaatcccac

SEQ ID NO: 4350 - DNA, 201 bp, Homo sapiens
tctttgtctagtttgttcacccactgatgtattccaaatacctgaatagtattgctcattaatacttgctaaatgaaagaatagaatcctctaacacttayggcttctatcacacaatttagccctgagttcaaactgtctggtattatttcctgttttatgtattccctaagccaaatcatatagtcactgaagaaaaga

SEQ ID NO: 4351 - DNA, 201 bp, Homo sapiens
ttgagggatgagtaggagttggttctcaattatttcacgtttaagtcgacatacttccctccctttgctaaactcgaattctttcactttctcagcaggaktatgcattaacttttaaaaatgaaagttaacggtttaatttttactgatggtctgtgctacttttgtgaaataaaaacatgagcaaagtggtagacagaa

SEQ ID NO: 4352 - DNA, 201 bp, Homo sapiens
cattcccacagctaaatcccgctcctcataggcagtgattttacctctttcacatatttcttctggcatttaccttcctatctctagaataacatacttamattaatggccaggcatagtgactcacgcctgtaatcccaacactttggtaggtcaagatgggcacatcgcttgagcccaggagtttgagatcagcctggg

SEQ ID NO: 4353 - DNA, 201 bp, Homo sapiens
tatctaaatataggctaattcaatttaaaggaatcccaactgagaggtaagattttcttcccctctaacacccaagtctggtctctaaggaggcccctacmaaacaatagttgtattagtcagcgataaaatttatttagggtcaatggaaatgaatttatgaatttgagactcaagggtacatgtcagtttcttcttggg

SEQ ID NO: 4354 - DNA, 201 bp, Homo sapiens
ctatgagaaagctttaacctaaatacaaacacattcttcaaaatatctgaccctcgccgttcaacagtgtcagaggcataaaagacacatctttgctaagraatcactacagattaggaggagaatattgcatgacaattaaatgcaatgtgggatcctggattggatcctagagctgaaaagggacgttagtaggaaaac

SEQ ID NO: 4355 - DNA, 201 bp, Homo sapiens
atcagcctgggcaacatggtgaaacctcatcagtacagaaaatacaaaaattagccagcagtggtggtgcatgcctgtggtcccagctacttgggaggctkaagttggaggatttctcgagcccgggagtttgaggctacagtgagctgtgattgcgttacagcacgacagcctgggccacagagagagaccttgtctcaa

SEQ ID NO: 4356 - DNA, 201 bp, Homo sapiens
aggaaaaatagtaactttacagtggagaatcctgatggacaccaccttaaccacatgatcaaggtcaatatcaaggatagtaagacatagtgagctcataygcccctgatagaatgtcctgaaaaggacagatcatgcctttcgaattcttcccaaacatccttaatctcatttgactatgagaaagctttaacctaaata

SEQ ID NO: 4357 - DNA, 201 bp, Homo sapiens
acatttgtatatctgtacttactatgtaaaaacaaaccaagataatgcttactttattagactattcaagactattccctacgccttttgattaattcagrgttcatgacttttgttagaaacaaattctgttacagatttagttcttcgcattttattctgtgataatttgccatccaggaaatggttccttacatgaga

SEQ ID NO: 4358 - DNA, 201 bp, Homo sapiens
ggtaagataggaaaatgacctagaagttgagaaataactcaaatccttaaaaatgaatctctaattaaagtcttttatattcatgttatttttctacttaagtaataattacattattttagattcttatgatacttttaattaaattgagataaaaattaagatttctttcatggttccctattggccatgcagtcataa

SEQ ID NO: 4359 - DNA, 201 bp, Homo sapiens
tgatcttgatctgcatgaatcagtaaggatgggctggataaacaagttggaaccacagttatgagtaccatgacattaactgaaacaaatgagaagggatkgaaaaatcggcggttaagtgtcttttaaggtcatttccaacaaaactacaaaggacctatgaaaggcttttcaggcacgtactcttgttgcctagctgaa

SEQ ID NO: 4360 - DNA, 201 bp, Homo sapiens
taataatgcctatcagattaaagaagttactttatttttgcatgaaattggttgtatttttgttgcactacttcatcctttgagtattgtgaaaagtctgygcattgactataatagcatttaaagccaagtttgaaggtctaagataatggcacacatccatgtcctttgctcacaagttctgcctaaagactttagcct

SEQ ID NO: 4361 - DNA, 201 bp, Homo sapiens
gagtgggttgggatattttcatcccctccggagctgtgtaaatatgttccaggccaaaagttcccaggagagtgtcattcctggggtctatttagtgccaygggcttgactcaaggaggatcctagtggcttcccgcaagagttggaaaattgtgatcccctggccatttttccacaatactggaagccggaaagtgtagg

SEQ ID NO: 4362 - DNA, 201 bp, Homo sapiens
gtctgcgcattgactataatagcatttaaagccaagtttgaaggtctaagataatggcacacatccatgtcctttgctcacaagttctgcctaaagacttyagcctgcttgaaacactctaaaggttgtgaaattaatggatataccactgatgcaacacaactcagtgtcaccagctagggagttaagacatgttcttgt

SEQ ID NO: 4363 - DNA, 201 bp, Homo sapiens
ttggggcagtgaaactattctgtgtgatcctctaatgaatgcatgatattatgtctttgtcaaaacccatagaacttggctgggcatggtggctcacaccrgtaatcccagcactttgggaggcagaggcaggtagatccattgaggtcaggagttcaagaccagcctggccaacatagtgaaaccccttctctactaaaa

SEQ ID NO: 4364 - DNA, 201 bp, Homo sapiens
ttaaacaataactgctgtaaaaccatggcatcagtgaggtataaagttttgtagaatcccaggctgaagactttttggatgtcgttttctcatttctttayattaaaaagaatataatttctttttaaaattaaaactaaaatgtccaccggcctcatattctttattgaacttaagtgctttgaaaatatttttgcgatt

SEQ ID NO: 4365 - DNA, 201 bp, Homo sapiens
tattattatacatacttaattttatttttgctgaaaatagtatggcaagccagtgcatctctgttagaaatagaaacttagtagccacctcaaaagcaagrtcataattctgtgaatcagctaataggtggtatttagcagttaggtatgggctaccctcgtgcctcatgactaatcacattgcttactcgtcatgcattt

SEQ ID NO: 4366 - DNA, 201 bp, Homo sapiens
actacatgttttcctaaagaatttggaactgattagaaacatcctgattttatttaaaagcaatataatgtatttttacagtttgttttcaagaaggttcaaaaaaaaatttttttttttttttgagatggagtttcgctcttgttgcccaggttggagtgcaatggcgccatcttggctcactgcaacctccgcctccca

SEQ ID NO: 4367 - DNA, 201 bp, Homo sapiens
tttcctaaagaatttggaactgattagaaacatcctgattttatttaaaagcaatataatgtatttttacagtttgttttcaagaaggttcaaaaaaaaatttttttttttttttgagatggagtttcgctcttgttgcccaggttggagtgcaatggcgccatcttggctcactgcaacctccgcctcccaggttcaagt

SEQ ID NO: 4368 - DNA, 201 bp, Homo sapiens
agtgcaatggcgccatcttggctcactgcaacctccgcctcccaggttcaagtgattctcctgcctcagcctcccgagtagctgggattacaggcgcccascaccacacctggctaattttttgcatttttattagagacggggtttcaccatgttggccagtctggtctcgaactcctgacctcaggagatccacctgcc

SEQ ID NO: 4369 - DNA, 201 bp, Homo sapiens
ggtggcttgccctgttgcctttttaggactgttttcatgggataattatcctctcacatgtctccatacacaggtgcaatcaaagtggagcctgcatctcmaccttattattctgagaagactcagctctacaataagcctcatgaagagccttccaactccctcatggcaattgaatgtcgtgtctgtggagataaagct

SEQ ID NO: 4370 - DNA, 201 bp, Homo sapiens
gcaaaggttaaaagtcccattttcagcatatttacatgtagtaacaacttgataacacagcgctgagaatgccaggctcagaggagccaagctgggctccygtccagtcagcctctagctcaccaggaaaccctgagcaggtcactttgcctcattttctttatctgtcaaatgagaactcagatgatctcaaaacagcct

SEQ ID NO: 4371 - DNA, 201 bp, Homo sapiens
aagtagaatcaaagcctagtgctagcccagaataagttattcaataaatgcttgttgagtgaataatcatccgaaatgattataatactgcctaccattcrttgaaagcttcagtatgtgggagaatctgtcctgggcactttatatacacccataatctgtttggatttcttggtaggaagactacatggctgcatacat

SEQ ID NO: 4372 - DNA, 201 bp, Homo sapiens
tagctgggaccacagcacatcaccacacccagctaatttttaaaaaattgttatagagacagggtctcactgtgttgtctaggctggtcttgaactcttargctcaagtaatcctcccaccttggcctcccaaagtgctgggattacaggtgtgagccactgtatctagcctagaatattttttatagtgctcaggagaaa

SEQ ID NO: 4373 - DNA, 201 bp, Homo sapiens
tactagttaactggagaggagaccaaacccaaaatattacaaaacatagatattaaaaatactgtgaacaacaatcagcccgctttctcccacctctcctrtaccagctaaatatttacctccctcatccgtagagggtttttggacaagacaggctggtgcctacatggtgaaagttgtttttctctcttttcttgtaat

SEQ ID NO: 4374 - DNA, 201 bp, Homo sapiens
aacactaaaccacaaatatacaacaaggccattttctcaaacgagagtcagcctttaacggtaagtaaaatcagaatttatactgcatttgtattgaaaartatcccttttaaagaatatgtaaattatacattgtattttattgtaaaatttcctagagagtgatttttgactattataatactttctgctatataattt

SEQ ID NO: 4375 - DNA, 201 bp, Homo sapiens
tttgtgtatgttgtaaggcaagggtttatctctttcatggggatatccagttgacctgcttcgtttattgaaaagatcatcctttgcccactccccagcaktgacatttctgtcataaaccaggtgaccatataggtctgggatttattctggacttactcttctattgcattgtatttttgcaccaattaagattgcctt

SEQ ID NO: 4376 - DNA, 201 bp, Homo sapiens
taggggaagcaattaaatgtgaaactgttatttaaaccggcaagtgtcagaatgttaacccacttcagagcgaaggctctaccagcaacatgtgtgttcastgcagaatgtgctggttacagatgatctttatctgtttgtcaaagcatttgcaagatctctattttatgtcatcccctttccctgaaagcagcagcagta

SEQ ID NO: 4377 - DNA, 201 bp, Homo sapiens
agtctgtgcagtaatagaggtatcgtcattcatgtgacataaaagatggaaaggggcttcattcatgttagtgatggaaataggaaagtaggtgaagtgawtctaatagatgtttcttttatgaaataatttttaaaagattctccagccctgcatgatttatgatgaatcattttgtggtctgttagttacttctagaga

SEQ ID NO: 4378 - DNA, 201 bp, Homo sapiens
ctgttatttaaaccggcaagtgtcagaatgttaacccacttcagagcgaaggctctaccagcaacatgtgtgttcactgcagaatgtgctggttacagatratctttatctgtttgtcaaagcatttgcaagatctctattttatgtcatcccctttccctgaaagcagcagcagtaaacgacattgctcctcaaatcatc

SEQ ID NO: 4379 - DNA, 201 bp, Homo sapiens
ttgagcctttcataagagataaggttgtgaatcctaagaccctaggaccatttacttagatgatctgctctctggttcgtcctctgaaaagtctgcttcgygaggggtgtgctgcatttgccttgcctaagtggtgtggcacacaactgtactgtcaccttaggcttaataaccatgtgtcatctagaatgaagttatatt

SEQ ID NO: 4380 - DNA, 201 bp, Homo sapiens
aaacatccggaaagcagcggggggcagggagggggaaggctgaagggaaaagaaaaaggctgaagggagcaataattgaggaagaaagaataggaaaaatrtagaaaggacccaagaaaatcagagaaatgagaggaaaagaaaggtaagaagaaaatgaggcaagtttacagagcagtaatgaaaatagtaatagctaat

SEQ ID NO: 4381 - DNA, 201 bp, Homo sapiens
attgctataggccacaccatgatactttgctgaattggatcagaaaagtaccctcaaattcccagcatcatttcttcaaggaagtagtgaattggggcacygtgggttttttgttttgttattgttcttaaaccaccttgcctatgtgcactcaactacaggaacgagaacttgcctgaaaccccaaacgtgtctgcatca

SEQ ID NO: 4382 - DNA, 201 bp, Homo sapiens
ccactgtggtcatctggttccctaattgagacacctcctgagaaaatctgtgctagggaaacacccagcccaggtgggcagatctcaagaggaccagaacrtttgaatctgcttcagataaaccctccacttaacagtaccagatctggacgagatggaagctttgtagatttgcccataatccacagtgctctgtaatca

SEQ ID NO: 4383 - DNA, 201 bp, Homo sapiens
agtttcatgtaggtaagactgtgtagaatgtcgggtctcgatgttggcgctattcaagccctgatgataaggcttttggcattagatgctgttttgtcttsatggaaaatacagctattctaggatccttgagcctttcataagagataaggttgtgaatcctaagaccctaggaccatttacttagatgatctgctctct

SEQ ID NO: 4384 - DNA, 201 bp, Homo sapiens
aaggttttctctcatttttcaaatagaagtactaaacaatgccagagaaataaataaacaggcaaaatacgttggctatagtttatattatttcctgctasagttaacaaaatgggaaaacattttatcttcatggtctactacatttatgccatgtgttaagtaataaaatagcttttgtaaattataaattaaaaggta

SEQ ID NO: 4385 - DNA, 201 bp, Homo sapiens
tctcgaactcctgacctcaggagatccacctgcctcggcctcccaaagtgctgggattataggtgtgagccaccgtgcctggcaaagaaggctcaaatttrgtgacttttaggactagagcagtttgatgtctgcaaaaatctagacaccaatttcttgaaggcaggtactgactgaattctattccagcatatagcacaa

SEQ ID NO: 4386 - DNA, 201 bp, Homo sapiens
taaatgaccagatggcagaggtgaaagaacggcaatccttggtgtctactccccccagaatggatcttgtctctgccctactgtgtttcacatctggggaygattccttctaagatacagtgcagttctgaatgggttcagaaggaagaggactggtagcaggagggggtctgggggaaaggttacctaaatctgcctgac

SEQ ID NO: 4387 - DNA, 201 bp, Homo sapiens
cagccattagggaggctgaggcaggagaatggcgtgaacccgggaggcagagattgcagtgagccgagatcgcgccactgcactccagcctgggcgacagwgcaagactccgtctcaaaaaaaaaaaaaaaaaaaatcaaccgctgttaggaaattctttttttttttttgtctctcttaaattcctcttaatctaaataa

SEQ ID NO: 4388 - DNA, 201 bp, Homo sapiens
tgaggcaggagaatggcgtgaacccgggaggcagagattgcagtgagccgagatcgcgccactgcactccagcctgggcgacagtgcaagactccgtctcaaaaaaaaaaaaaaaaaaaatcaaccgctgttaggaaattctttttttttttttgtctctcttaaattcctcttaatctaaataaagacattttattttgt

SEQ ID NO: 4389 - DNA, 201 bp, Homo sapiens
aatagattttcaaatattaaatcctctttgcctttctgagataaatgtaacttgattatggtggttcattattttaatagaggatttaatttgttaattarcattttatttattatttaaaatcaatattgataagtgggactgatatttttctctgttgtcaggttttaatatcagtgttatgacactccagaaaagtta

SEQ ID NO: 4390 - DNA, 201 bp, Homo sapiens
aaggtaagataggaaaatgacctagaagttgagaaataactcaaatccttaaaaatgaatctctaattaaagtcttttatattcatgttatttttctacttaagtaataattacattattttagattcttatgatacttttaattaaattgagataaaaattaagatttctttcatggttccctattggccatgcagtcat

SEQ ID NO: 4391 - DNA, 201 bp, Homo sapiens
aggtaagataggaaaatgacctagaagttgagaaataactcaaatccttaaaaatgaatctctaattaaagtcttttatattcatgttatttttctacttaagtaataattacattattttagattcttatgatacttttaattaaattgagataaaaattaagatttctttcatggttccctattggccatgcagtcata

SEQ ID NO: 4392 - DNA, 201 bp, Homo sapiens
gtaagataggaaaatgacctagaagttgagaaataactcaaatccttaaaaatgaatctctaattaaagtcttttatattcatgttatttttctacttaagtaataattacattattttagattcttatgatacttttaattaaattgagataaaaattaagatttctttcatggttccctattggccatgcagtcataat

SEQ ID NO: 4393 - DNA, 201 bp, Homo sapiens
ttgagtctgtattaaaattttttttttatttttgagacagggtctcactctgttgcccaggctggagtgcagtggtgtgatcatagctcactgcagccttsaactctgggactcaagagttcctcctgcctcagcctcttgagtagctgggactacaggcacatgccaccatgcccagctaatttttctgttttttgtaga

SEQ ID NO: 4394 - DNA, 201 bp, Homo sapiens
gcattacacactgacacattagctctttctaaagaagaacatgtcccattctgaaaagaaaattattgctttgtttttgatattgagtctgtattaaaatwttttttttatttttgagacagggtctcactctgttgcccaggctggagtgcagtggtgtgatcatagctcactgcagccttgaactctgggactcaagag

SEQ ID NO: 4395 - DNA, 201 bp, Homo sapiens
aagtcttcagcagttatattccacttcattgccagggtgtctggctctaaggggaatctctgcttagaggaccattaatccttaggaaccttttttttttwaaaaaatctaaagatggttcctggacatcatttaccaactggcagtttaaatggcctgtgtaccataaattgtgaggttaaaaaaaatctggtacacagg

SEQ ID NO: 4396 - DNA, 201 bp, Homo sapiens
ggcattacacactgacacattagctctttctaaagaagaacatgtcccattctgaaaagaaaattattgctttgtttttgatattgagtctgtattaaaawtttttttttatttttgagacagggtctcactctgttgcccaggctggagtgcagtggtgtgatcatagctcactgcagccttgaactctgggactcaaga

SEQ ID NO: 4397 - DNA, 201 bp, Homo sapiens
ggcttacttggtttgtctgcatgtttccttctgtcatcccccactcctaggacccatatggaacattctctcttaattaactcttttattgaagtataatrtacttagaggaaaaatgtccaaatcattttcacaagtgaacatacttgcgaaattagcacccagacaaaaaaaaaaaaaaacagaacaataccagcactc

SEQ ID NO: 4398 - DNA, 201 bp, Homo sapiens
agcctaccccagcagagaggacccttggccctggccctactccagactcaactgtaacctcagcaaggtgcagggagaggatctcaggtgggcctcctggsaacagtgccttttcaggcactaggctgttgggaatggagagagaagagaaaggccctggcactgtctgggtatttggatggatttctgtggcacaactgt

SEQ ID NO: 4399 - DNA, 201 bp, Homo sapiens
aaaggactgagtgtgcgtggagcagaaaggggaaagagactagtggggagctggtgaccagttggagggtggagggtagggaacaaccctggcagatccaktttgcccttgactagagcttaaagaccaaaggaagcgttcttgtttttaagtaagtcaggtgttctaagtttaatgttaatatgctttttcaattagatg

SEQ ID NO: 4400 - DNA, 201 bp, Homo sapiens
ggtagggaacaaccctggcagatccattttgcccttgactagagcttaaagaccaaaggaagcgttcttgtttttaagtaagtcaggtgttctaagtttartgttaatatgctttttcaattagatgtttgagtatatttccccagttgaattatgtagagggaattacaaatgagaatacatcttacaatttttgaatta

SEQ ID NO: 4401 - DNA, 201 bp, Homo sapiens
ttccctaaaccatcttgccttaacggaggctcagtcagggggacaatgggactgatctgtaaatgatctaacttgtcattgcagaaaatatacttactccrtggccacaaaatttcagcccttcagccaagcttcatccatcacatcataaagaataacttgccaaagaggggtttgaaaatccaaaccagatccctctcc

SEQ ID NO: 4402 - DNA, 201 bp, Homo sapiens
ttcatcaagcaggaggatctgtagtcattaaaccaaggtgccagtctggggcccagccttcaatgaagcatcagtggctttttcattcccatagagcaackgcgaggaagaccccatgctcccaggggcccaattctccaggccaggaccagatcatttgttccttctcagaatctgagatcttttgctgatggttccaaa

SEQ ID NO: 4403 - DNA, 201 bp, Homo sapiens
ccaaggtgccagtctggggcccagccttcaatgaagcatcagtggctttttcattcccatagagcaactgcgaggaagaccccatgctcccaggggcccarttctccaggccaggaccagatcatttgttccttctcagaatctgagatcttttgctgatggttccaaaattgaatgctgaaatctaaaaagaaaattata

SEQ ID NO: 4404 - DNA, 201 bp, Homo sapiens
atcttgagttaaatgaccagatggcagaggtgaaagaacggcaatccttggtgtctactccccccagaatggatcttgtctctgccctactgtgtttcacrtctggggacgattccttctaagatacagtgcagttctgaatgggttcagaaggaagaggactggtagcaggagggggtctgggggaaaggttacctaaat

SEQ ID NO: 4405 - DNA, 201 bp, Homo sapiens
ctggcttctagggatgatgggtagggtgtttataatcgaatgaatataaactaatcttgagttaaatgaccagatggcagaggtgaaagaacggcaatccktggtgtctactccccccagaatggatcttgtctctgccctactgtgtttcacatctggggacgattccttctaagatacagtgcagttctgaatgggttc

SEQ ID NO: 4406 - DNA, 201 bp, Homo sapiens
atgttctcaaatgagaaaattgactgcaagaacatttgtccaaatacatgtttttatatattttatgctactttccagaatattaacagttttacatagcrctgttttggaagtcactcattgttttcatctttctgattaagaaatagggccaaagttgtacattgcactagtagtagacttttaaagatgtctttgtct

SEQ ID NO: 4407 - DNA, 201 bp, Homo sapiens
ggggaagcgaagatccgcgtgcgtccgtcctgaggccgcgcggcacccctgctgaggaggaggtcccgttcgctgtccagagcccaggggcgaccgccgcktggggaccgggggaccgttcagcgaggggcgcgcttgtagctggccaggccctgtgccctgacgcgttgtgctggccctacgcccggcggaggggctggg

SEQ ID NO: 4408 - DNA, 201 bp, Homo sapiens
caggagaatcgcttgaacccaggaggtggaggttgcagtgagccgagattgcaccactgcactccagcctgggggacagagcaagactctgtctcaaaaawaaataaataaataaataaaggcttagtatagaactcttcccagtcttttttctccactttgattttttttttttttctcaatctcttccatgacaattca

SEQ ID NO: 4409 - DNA, 201 bp, Homo sapiens
taagaaaatcatctcttccttgaaagctttaaaaaatcaactataaaactaatagcttttggaggaagtaattctttgataagttttcaattatttccatygttaattatttttctgtatcttaagtcaacttcaccatttatttcatttcagacaagttagtctgagtaaactgcccttggcctgccttattatttactt

SEQ ID NO: 4410 - DNA, 201 bp, Homo sapiens
tgtgttttgcctgttgtgtgtaatgagcggtttcgctgtgggtgctcctttcatttctggctaacacattagagtgtgtttatgtaaattgctgtgatacyggtcagcagtcacagccagaaaacataaaacatgtgggcattacacactgacacattagctctttctaaagaagaacatgtcccattctgaaaagaaaat

SEQ ID NO: 4411 - DNA, 201 bp, Homo sapiens
gcttctttcagcatcactcatcaagttgaaatttatgagtgtcctttgttatcacaaacaaagcaagcaaactgaacaaatgagaatgcttctttagtatytacatagcactttaaaagctctgttttctttacaaaatgtgtgtatggaaaggtaaaatgggaataaatagtattaaattctgttcttagaacctactgt

SEQ ID NO: 4412 - DNA, 201 bp, Homo sapiens
ttcaagaattttgttgcaagccagttgttaaacacagccattataattatgtaaatttgcaaattatgttaaaaacaaggacaataaatactcaaaatgcaaaaaaaaaaaaaaaaacctactgcatagtgtaatagtgctctcacttttctctccttgattctgatgtcaatcactcattgtcacctccactagaggggg

SEQ ID NO: 4413 - DNA, 201 bp, Homo sapiens
atcactcattgtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataa

SEQ ID NO: 4414 - DNA, 201 bp, Homo sapiens
aggttctgttgagtgacgcagataggaaataacctagctgcatggttgctgtctttcaaaaggccgtactcttaggatccacatacaggcccccatcttcygtgaagccattgtccccagccatcccattttgacgagtttttttgagtccctgtgaaactttggcttttttacatttatctggcagttaactaggtgctg

SEQ ID NO: 4415 - DNA, 201 bp, Homo sapiens
cacttggtgattctagtcacctctattttgttataggataactggttttctctgagttttacaccagaatgccttcttcttttaatacgccttcttacttrgtgcttttctcatgatcattttcccaaacttcctaatggacatagtgtctcattttctgtctgtttttaaacctgatactttggagtttaatccatcaaa

SEQ ID NO: 4416 - DNA, 201 bp, Homo sapiens
tgtctcttaaatagcaaagttttttgacctgatttactaaaaaaaagtttgttgacttggcttaaattttattttcttttctttttttctttttttttttytttgagacagagtcttgctctgtgaccctggctggagtgcagtggtacgattttggctcactgcaacctctgcctcccgggttcaaacaattctcgtgcc

SEQ ID NO: 4417 - DNA, 201 bp, Homo sapiens
tttaaaggaatcccaactgagaggtaagattttcttcccctctaacacccaagtctggtctctaaggaggcccctacaaaacaatagttgtattagtcagygataaaatttatttagggtcaatggaaatgaatttatgaatttgagactcaagggtacatgtcagtttcttcttgggaaaatccaaggtaatattcacag

SEQ ID NO: 4418 - DNA, 201 bp, Homo sapiens
agtagccaggattacaggtgcccaccaccatgcccaaccaatttttatatttttagtagagatgggttttcgccatgttgtccaggctggtctcgaactcytgacctcaagtggtccaccctcctcggcctcccaaagtgttgggattacaggtgtggaagccaccgtgcctggctgacttgggttaaatttttaagttta

SEQ ID NO: 4419 - DNA, 201 bp, Homo sapiens
ctgagaggtaagattttcttcccctctaacacccaagtctggtctctaaggaggcccctacaaaacaatagttgtattagtcagcgataaaatttatttasggtcaatggaaatgaatttatgaatttgagactcaagggtacatgtcagtttcttcttgggaaaatccaaggtaatattcacagagtactcagatgggaa

SEQ ID NO: 4420 - DNA, 201 bp, Homo sapiens
caccacgttctaattacagatttccaataaaagtattaatatgattcctacatcaatgagctaatcattagaagtagaaggcaatgtggggaaaaaaaaamaaaacaagaatggcagcactgacctagtttctagttgccaggaccaaagacgtcgtgacaccactgtcctttctaaatctccttaccttgcttaatctta

SEQ ID NO: 4421 - DNA, 201 bp, Homo sapiens
gcttgagaattgatgctcagtcttatttatattattctatccctagttatgtgatacttaactgtattgctcggtatttagcagcccattatctaatcatwacatcaccctcattctttctgagcttgtttcctttttgtgaaatggggctaccattcaatctcaccgaattttttttttttttttttgagacagaatctt

SEQ ID NO: 4422 - DNA, 201 bp, Homo sapiens
tttgccacaggtaaggagaaggtagatatgagggaggtagagaaatagggaaataccctgagtaggaatgtaccaggtctgtatatgctcaactcccacartcagcaggttgcatgattactgtgtatagtcttaaaatataaggttgatttctaagaatttaccctgcttcttggtgacattgtaggacatctcagtttg

SEQ ID NO: 4423 - DNA, 201 bp, Homo sapiens
atgtgtggatatgacatattgagtcagattatctgaccttctgagaagagttcagattagcaaaaacgtggggtgagaagtccttcgcagtttgccacagrtaaggagaaggtagatatgagggaggtagagaaatagggaaataccctgagtaggaatgtaccaggtctgtatatgctcaactcccacagtcagcaggtt

SEQ ID NO: 4424 - DNA, 201 bp, Homo sapiens
ctcggctgaggggtccggggctgaggcagggtcatggtccggcaggacccggactgacgggtcgcgggcgggcggctcacgggtgaccgggtgaaggggtyttgggctgagggcacccgggctgagggtcgcgtctaccggagcgcgcactaggggcggagggcgcgggcacagagagccgcggccggtgccgactcgagt

SEQ ID NO: 4425 - DNA, 201 bp, Homo sapiens
gggagtgtttgttcagttctagcaaaagcaagaaaatatatgaattaagtgtcatgacatcagagacttaggcagttcaacacttaaaaaattgcaaacakaactaagaaaacctcagaggtttttatgggagtttgtttgctgcacagaaaataaacatcagactaacaacaaggttttgattagttttgcctgttagct

SEQ ID NO: 4426 - DNA, 201 bp, Homo sapiens
cgaaggcaaagaaaggctcatgctggtgcgtgtaggtgggctgagtgtccctgtccgggagtggggagccgtgttatcttccactgccttaatcctacagygtaggctttctcagagtcattgccataccttcaactgttccagtggccaggctgttctcaacttgaaaatcttttgtgggacagtgccatgaattttttt

SEQ ID NO: 4427 - DNA, 201 bp, Homo sapiens
gggggctgaggattgttggagaggacttctcccaccttctctgggccccaaactgcacactggactggcaagccactctgcccactgcagtgtggagctayaaagcccaagtagggacttcactaaaaggatgcagaggcgaaggcaaagaaaggctcatgctggtgcgtgtaggtgggctgagtgtccctgtccgggagt

SEQ ID NO: 4428 - DNA, 201 bp, Homo sapiens
atgggaagttactggtaacagcacacggggtgatggggtgaagaggcttgtgtgcgtgggccccgggggctgaggattgttggagaggacttctcccaccytctctgggccccaaactgcacactggactggcaagccactctgcccactgcagtgtggagctacaaagcccaagtagggacttcactaaaaggatgcaga

SEQ ID NO: 4429 - DNA, 201 bp, Homo sapiens
gcaactgccaaactgcttttcacagctgctataccattctgcattcccactgcaatatatatgggttctaatatctctacattgctacaacaccttttttwaaaaaaaaaaaaaaaaaaaaagctgtcctattaggtgtcaagtgttatctcattgtggttttgatttgcattttcctaatggctgctgatgttaagcatc

SEQ ID NO: 4430 - DNA, 201 bp, Homo sapiens
cagagcaagaccctgtctcaaaaaaaaaaaaaaaaaaaaaaaaaaagggagaaactgatttcaaggagccaagaaaagagacagattcaatagtggaggaygggcaaaatatcaaatgctgcagaggcagagaccgtggtgtgctggagccacattgttaaattttcacaattttattgagccaatcgttatgcatgctat

SEQ ID NO: 4431 - DNA, 201 bp, Homo sapiens
ttgctcggtatttagcagcccattatctaatcataacatcaccctcattctttctgagcttgtttcctttttgtgaaatggggctaccattcaatctcacmgaattttttttttttttttttgagacagaatcttgctctatcacccaggctggagtgcagtggggcaaactcggctcactacaacctctgcctcccaagt

SEQ ID NO: 4432 - DNA, 201 bp, Homo sapiens
tccattcatctactgatggatacttgggttgtttttgccttttgctattgcagataatgcttcagtaaacattggtgttcaagtatctgttttagtccccrcttttagttcttttgggtatatacccaggagtgaaatgctgggtcacatggtaattctgttttgctttttaagcaactgccaaactgcttttcacagctg

SEQ ID NO: 4433 - DNA, 201 bp, Homo sapiens
tcggtatttagcagcccattatctaatcataacatcaccctcattctttctgagcttgtttcctttttgtgaaatggggctaccattcaatctcaccgaattttttttttttttttttgagacagaatcttgctctatcacccaggctggagtgcagtggggcaaactcggctcactacaacctctgcctcccaagttcaa

SEQ ID NO: 4434 - DNA, 201 bp, Homo sapiens
actgctaattcttgattgtagaacaaattttcctatgaaaaccatgttgtgtattttatatctctattagttcgttaaaagtttagcagttttagatgtcsaaccagtaaaaaacaagttgcccattctatcatttttttttattgtggtaaaatatatttaagataaaatttacgattttaaccatcttaagtgtacatt

SEQ ID NO: 4435 - DNA, 201 bp, Homo sapiens
tataaatggattttgattgatttttttaaagtattgactcactaatcttcaaattggtagaaggaggtcagtagactttgactcataaatttttgtaagcrtaatggcttgttgaataactcctaattgtctttaacaaccttggtttctgtcctcttttttccaaatgcagatatagcagatgtcttcagcatctaattt

SEQ ID NO: 4436 - DNA, 201 bp, Homo sapiens
gcgtaggcactcaataaatgtggaatctgaatcttacttaaagctagtttatattttcaagtcttcttacttttactaatgctgctttaagatatattctrtaagttcaaatgtaaagttctagattgggaaagaatttataatgtgtctaataaagattgttagagacaaacttttagactgaaccaatctactattaat

SEQ ID NO: 4437 - DNA, 201 bp, Homo sapiens
tttttttatagaggcagggtctcactctgttgcccaggctggtctccaactcctgggctcaagggatcctcttgccttagccacccaaagtgctgggattrcaggtgtgagccattgcacctagcagcattattttcctttaaatcaaaataatataattgtttaatataattatgtccataaaatatattacttttgaaa

SEQ ID NO: 4438 - DNA, 201 bp, Homo sapiens
ccccggtcaaaaatttttttaatttaaaaaattttccaaaaggggcacagatacattgaacattgaccttcctttgtctgcttttatgggactatccggcttgttgtgatggttgtggtgaaatttacatccaggatacaggattatttgttcttctcaaaggagtgtcccattggcccagcatttctctcatgttgtctc

SEQ ID NO: 4439 - DNA, 201 bp, Homo sapiens
cccggtcaaaaatttttttaatttaaaaaattttccaaaaggggcacagatacattgaacattgaccttcctttgtctgcttttatgggactatccggcttgttgtgatggttgtggtgaaatttacatccaggatacaggattatttgttcttctcaaaggagtgtcccattggcccagcatttctctcatgttgtctct

SEQ ID NO: 4440 - DNA, 201 bp, Homo sapiens
ccggtcaaaaatttttttaatttaaaaaattttccaaaaggggcacagatacattgaacattgaccttcctttgtctgcttttatgggactatccggcttgttgtgatggttgtggtgaaatttacatccaggatacaggattatttgttcttctcaaaggagtgtcccattggcccagcatttctctcatgttgtctctc

SEQ ID NO: 4441 - DNA, 201 bp, Homo sapiens
cactgtagtcatttggacaaattagcaaacccaagttttgctttaacttggattgccttaataaagatgttttggggcttaatggcacagttgctcaactcccccactttattccgtgatgttcagacccagccagcatttccccatcaggctcttgcaccatgattgacagggacacttttactagtccccttgaagaat

SEQ ID NO: 4442 - DNA, 201 bp, Homo sapiens
tacttgtgcaagtagatctaaagccctatatggaatttattgctttagccttgtagcgttaatcacttgtggctagaatagaaggctccgtttaaaaaaaraaaaggctgggtacagtggctcacatctgtaatcccacaactttgggaggccgaggcgggcagatcacgaggtcaggaggtcaagaggtcaagaccatcc

SEQ ID NO: 4443 - DNA, 201 bp, Homo sapiens
gaggtaggagaatggcgtgaacccaggaggcagaggttgcagtgaggctgagattgcgccactgcactccagcctgggcgacagagcgagactccatctcaaaaaaaaaaaaaaaaagaaaagaaacctacattttaaacactttatggatatggaaaaacaaaaaccgcagaactctttattgcacaagagtaagtggca

SEQ ID NO: 4444 - DNA, 201 bp, Homo sapiens
tcgtgatctgcccgcctctgcctcccaaagtgctgggattacaggcatgagccaccgcgcccggctttgtagctcagtttttaatgacagggtttggcttygattctgatgtctgcacaacgctcccagggctgtaagaactgcagaacacactgagaagacaccgtcccagccatggaaagcccttctatgcagtcattt

SEQ ID NO: 4445 - DNA, 201 bp, Homo sapiens
cttaaaatataaggttgatttctaagaatttaccctgcttcttggtgacattgtaggacatctcagtttgccacttagcactgttattctttctggctctrtactaaaggagataatttgggcaagggaatggaaagaggttactttttcatcctgtatgtttaaggaataaattttccttcatatcgagggcagtggaga

SEQ ID NO: 4446 - DNA, 201 bp, Homo sapiens
tcagtccagatcctgtgatctgaaataatttaaattattaaaagttagatatttttaaccttttatactcccactagacaggacataggaaatttagtgaygtaagcatctttaataatccttaaaagtcataagacttggtggctgggacaagaaacaattaggtataaatttcagggaaataccataatggcatgactt

SEQ ID NO: 4447 - DNA, 201 bp, Homo sapiens
tattctcaactttctgtttgggggttcagtgtctccttccacagttttctttgcctcaaataaataaagccaattatgagctctacagtctgagttatagyattcttggttctttgggtaccgccaataacttatatatcacaaataatacatatacagtgttacatagtaagtgctcaataattggaagctagttccatg

SEQ ID NO: 4448 - DNA, 201 bp, Homo sapiens
tgatttgtagttcaactgttgatcaattatctttgagacttttaacattcatgactaaggaggattaataattaacatgagctgtagaattaaggtttgtrtggcatgataagtataaaccagttttgggaccgctataattctaaaaaagcaggtagactagatgattagttgtacacttattactgctaattcttgatt

SEQ ID NO: 4449 - DNA, 201 bp, Homo sapiens
ctccccaactaatcttccttctcctgtatcttattccctagggccacttgcacctttcaaaatggataaattaaattcccctgctccccttctaccaactytaacatcatatccttggtgtatgatgccctacttttcattgttttgcctaaataagagtatgcttgggaattttaggcttagggctgggaaaagatggga

SEQ ID NO: 4450 - DNA, 201 bp, Homo sapiens
gtatatttttatctactaaacacatgatcaaatagggattttttattctgaatttaacattaacagaaatgttatgttgctctttatgagacgaaataaarttggatgtcacttataaatggattttgattgatttttttaaagtattgactcactaatcttcaaattggtagaaggaggtcagtagactttgactcataa

SEQ ID NO: 4451 - DNA, 201 bp, Homo sapiens
actaaactacaattgtttggcaccctctcttctccttatcttgcaaaatcaaattaagcactagtggaaagaaacagttcagagaggaatatgggaaaggraaaaaaaaaaccaaaatgtgatttccaacgagactagagatttgttctttatctacatggtcatgttactcatttgatagcatctatctcaggggtatta

SEQ ID NO: 4452 - DNA, 201 bp, Homo sapiens
ccctttttcgttcctggtgttccctatgttttcttctttccttcttttctgtctctgtttctctccctctgaatttctgcttcctttcctctctttcccarttgctactgtctctgcctttggttgtctctgagtgtaatatggaagtgaagtatatttttatctactaaacacatgatcaaatagggattttttattctg

SEQ ID NO: 4453 - DNA, 201 bp, Homo sapiens
cgtggtgtgcacctgtagtcccagatactcgggaggctgaggcaggagaatcgcttgaacccaggaggtggaggttgcagtgagccgagattgcaccactrcactccagcctgggggacagagcaagactctgtctcaaaaaaaaataaataaataaataaaggcttagtatagaactcttcccagtcttttttctccact

SEQ ID NO: 4454 - DNA, 201 bp, Homo sapiens
aaactctgtgagattgctgtgttctctaggacttaacttcacagctagtctatttttcctttcagaaatgaccatggttgacacagagatgccattctggsccaccaactttgggatcagctccgtggatctctccgtaatggaagaccactcccactcctttgatatcaagcccttcactactgttgacttctccagcat

SEQ ID NO: 4455 - DNA, 201 bp, Homo sapiens
tacagaattgaattaagaaaagaatttccatgagagatatgcatttacaattttgtagatttaatctttgcatagacttttttgttgcagatactgaaaakgaatccataaaaatacatagatccctttactagccacttttaatttacggatgaggaatattcagttcacagactggctagcgctttttagctttcttta

SEQ ID NO: 4456 - DNA, 201 bp, Homo sapiens
attgtctgaataaataccaatatctactagtatttatttccttgctggtaataatgtgttttcattaatttaagatttataggaacatacttgggtgctcygcctgctagaaactgatctgtagcatgagccatttgttgaaagtacttagatatttctgcatttatttatttctgtttcagaccccacaataactatatt

SEQ ID NO: 4457 - DNA, 201 bp, Homo sapiens
atatagtataataccatttaataaagcctcaaaacaagcaaaattaaatagtatattattttgttttacatagtatgtgataaagctgtattttcttccttttttttttttttttttttttttgagacaatgtctcactctgtcacccagactggagtgcagtggtgcaatcataacttggcttactgcagttagacctcc

SEQ ID NO: 4458 - DNA, 201 bp, Homo sapiens
tatagtataataccatttaataaagcctcaaaacaagcaaaattaaatagtatattattttgttttacatagtatgtgataaagctgtattttcttccttttttttttttttttttttttttgagacaatgtctcactctgtcacccagactggagtgcagtggtgcaatcataacttggcttactgcagttagacctcct

SEQ ID NO: 4459 - DNA, 201 bp, Homo sapiens
ttgtgtatcagtagtgtcattctgctttaaatgtaagaaaatcctgaagatgtctgggtctgaaactttaaatggcatatgagaatttagattcatttaattttttttttttttttttttttgctgtttattatgcaaagacgagtattcgtttccttcacttcaaggaacgtccatgagttgtggaaagggtaaaacaaa

SEQ ID NO: 4460 - DNA, 201 bp, Homo sapiens
agtcctttatagtaattgcattttaaaaatatgtcttctttattttttattattatttttttttgagatggagtctcgctctgtcacccagtctggagttmaatggtacaatcttggctcactgcaacctccgcctcccaggttcaagcaattctcctgccttagcctcctgagtagctgggattacaggtgcccgaaacc

SEQ ID NO: 4461 - DNA, 201 bp, Homo sapiens
cccaaagtgctaggattacaggcgtgagctaccacactggccttgtcctctttatttttaataaaattatttagtcattaagaattttggcttgtgggccrggcatggtggctcatgcctataatcccagcactttgggaggccaaggtcagaggaccacttgagctgaggagttcgagaccagcctgggaaacatgacaa

SEQ ID NO: 4462 - DNA, 201 bp, Homo sapiens
ggtagttctctcagtgccttgcaaacagcagctctagtgtatattgagaaaaggaaaaattctgaatggcaaatactagatttcaactttaacctattcctttttattattattattattattattattattattattattattattattgagacaaagtctcgctctgttgcccaggctggagtgcagtggcgcgatcta

SEQ ID NO: 4463 - DNA, 201 bp, Homo sapiens
gtagttctctcagtgccttgcaaacagcagctctagtgtatattgagaaaaggaaaaattctgaatggcaaatactagatttcaactttaacctattcctttttattattattattattattattattattattattattattattattgagacaaagtctcgctctgttgcccaggctggagtgcagtggcgcgatctag

SEQ ID NO: 4464 - DNA, 201 bp, Homo sapiens
caacatagaaataaatttagttatttagcaatttgttgtatttttggccctgcaagtagtacatgatctgactaaccaattccaaaagccagattttcttytgagtgtgacttttttcttttttttttcttttttttttttcctttttttttttttttttttttttgtgagacagggcctcactctgtcacccagactgaa

SEQ ID NO: 4465 - DNA, 201 bp, Homo sapiens
gtctttcctcttctgttctttggccatcgtttaagtttccttacctgttaagtaagaaaggtttatgttaaggatcaagtaagatcaaatatataaagggyttagaaataatttacggcgtatatttatggtattactgtaataattgccttgacttttttatcttttccaaatgaataaatcaaaatagaaagaggttga

SEQ ID NO: 4466 - DNA, 201 bp, Homo sapiens
acgatcttgactcactgaaacctccgcttcctgggttcaagcgattctcctgccttaccctcctgagtagctgggattacaggcatgcaccaccacacccrgctagtttttaaaagtatttttagtagagatggggtttcgccatattagctaggctggtttcgaactcctgacctcaagtgatctgcccgcctcagcctc

SEQ ID NO: 4467 - DNA, 201 bp, Homo sapiens
ctgaccttttagttatactttggaagaaccttaaccatgttgttccagggaaattcactgctttgggagccaggtcactgagttactactgtctttcctcytctgttctttggccatcgtttaagtttccttacctgttaagtaagaaaggtttatgttaaggatcaagtaagatcaaatatataaagggtttagaaataa

SEQ ID NO: 4468 - DNA, 201 bp, Homo sapiens
tgccagagttagaagaccgctgccctaaaggatgaatgagtggagttgatgactgactcctgtagggcagtctttttttttttggagatggagtctcactstgtcacccaggctagagtgcagtggcacgatcttgactcactgaaacctccgcttcctgggttcaagcgattctcctgccttaccctcctgagtagctgg

SEQ ID NO: 4469 - DNA, 201 bp, Homo sapiens
taccatgttaagttgatcctaaaataagaaatctaagggaaaggtcacatcctaataacttgtgcaaatctaaattcccatggagctttgcaatcattttgtaggagtataaaaaatctattattgaacttcttccagatagcgtcgtaaaattgaagtacttttatatacagaagtaaccactaaattataaatacaatt

SEQ ID NO: 4470 - DNA, 201 bp, Homo sapiens
taaaactttaatattattatgatattcaagcgcatgattttgcatttcatagcaatatccacagtaggtgtaagagacaagaaaacttccttcatgccagrgttagaagaccgctgccctaaaggatgaatgagtggagttgatgactgactcctgtagggcagtctttttttttttggagatggagtctcactctgtcac

SEQ ID NO: 4471 - DNA, 201 bp, Homo sapiens
gctagggaaacacccagcccaggtgggcagatctcaagaggaccagaacgtttgaatctgcttcagataaaccctccacttaacagtaccagatctggacragatggaagctttgtagatttgcccataatccacagtgctctgtaatcaattccaggaccgtgtggatggagaccggaaaggtttctttcccaattcttc

SEQ ID NO: 4472 - DNA, 201 bp, Homo sapiens
gatttcagttttgtctgcatcacagagatgtatgtttccctaagtttgctcactataatttgtgattgctatttttcttatctgcgaaggaagtacagcarctcccactggggaaataccatgttaagttgatcctaaaataagaaatctaagggaaaggtcacatcctaataacttgtgcaaatctaaattcccatggag

SEQ ID NO: 4473 - DNA, 201 bp, Homo sapiens
ggggggctggaaaggcgaagtcgctgctttgtgggctcctgcaagtgccaggcgctgaccactcctcctgggagcctaactgaggggggtagaggcagcaraggttaacagaaatctcaggtcccttggtggaaggtgggtgtgtagtcgtggtactttacgcctcggtgtttagggaggagcctaaggtaaggagtcaga

SEQ ID NO: 4474 - DNA, 201 bp, Homo sapiens
tacaagctaagggagaggcaccatcagagagatctggagagcagctggcagaatgttagaggacccagaacagcaggaaccaggacaagaaattttggaartaagagggcggagatggtcaccagaattaaaggctgggagaatactgaagagctcaagtctattgagaacttagaagaggccattagttctggccgagag

SEQ ID NO: 4475 - DNA, 201 bp, Homo sapiens
tctgacaataaggatgttagccactaaccttaattatcaagataattatgtgcatgaaagctgtgtaaaaggcacaaccgtggaacatatacaagtattartaatacatttcatttagttttcaggttataaaatcgttattaataacaagaggctttcatgaagtaggaaaatatgttaaaatgacattttctgaatgtt

SEQ ID NO: 4476 - DNA, 201 bp, Homo sapiens
ctcggtgtttagggaggagcctaaggtaaggagtcagaaacggggagtaaccgagctgcggcttttatataaggtcagtggtaggtaaggaaggggccttwacctctgctggtgaccagaagcctgcatttctgcattctgcttaattccctttccttaggtgagttggctcactctcattgcattttgttggaatgtgtt

SEQ ID NO: 4477 - DNA, 201 bp, Homo sapiens
atgataaacgggacctagtagattaacatcatctcctcagcccaagggctgaccccagtggtgctgctcaagaggaaggaggaggctgggagcggtggctyccgcttgtcatcccagcactttgaggggctgaggagggcaaatctcttgagcccagcattcaagagcagcctggaaaatgtagagattctgtctctacca

SEQ ID NO: 4478 - DNA, 201 bp, Homo sapiens
ttactgtgtatagtcttaaaatataaggttgatttctaagaatttaccctgcttcttggtgacattgtaggacatctcagtttgccacttagcactgttaytctttctggctctatactaaaggagataatttgggcaagggaatggaaagaggttactttttcatcctgtatgtttaaggaataaattttccttcatatc

SEQ ID NO: 4479 - DNA, 201 bp, Homo sapiens
cctctattatgatacctgggtaaagggtgacttcctttctatcataaaacagcctagacagcactaagaaggtggttatgttcttttctgttgttgtgagygcccagatgagattactttgccaaagactcttttcatttctctttctgaaactctgtgagattgctgtgttctctaggacttaacttcacagctagtcta

SEQ ID NO: 4480 - DNA, 201 bp, Homo sapiens
taagtctatttttttctggtggtgtgttattcttctcatagagaactccattttttcattatgacatagcacttatcgtttaaacatcaattgatgttcaracatcagctggtgtaacattgctgcagttgctattgatggataagctgaagtttttaagaaagcaaacccgatgtataaaattgaaaccatatcaaaccc

SEQ ID NO: 4481 - DNA, 201 bp, Homo sapiens
ggattgttttgatgccatgctccctcagctgaccacacagattacatcctggccagaaaaaggccctgcaaagagctctgatcattttggttctgattccrtccttagttcttacccattatctgcttacccttcctccccacctatttaagatacaaagcaaaacaaaccaaaaatacagatgagttgcttggtagagct

SEQ ID NO: 4482 - DNA, 201 bp, Homo sapiens
tctgagtagaaacacgttagcagaggaaacttcatttggggaacaggattgttttgatgccatgctccctcagctgaccacacagattacatcctggccakaaaaaggccctgcaaagagctctgatcattttggttctgattccatccttagttcttacccattatctgcttacccttcctccccacctatttaagatac

SEQ ID NO: 4483 - DNA, 201 bp, Homo sapiens
ttggccagaacagccttctcgctcattaactcagtcaaccaaatgcttcctgtgtttccactggtggttcagaacgtagtctctgccctctgatacctcayggtctaacgggggagaaacaagaaagtcagaacttacaatacaagataataaggaataagagcagagcctttggaaccagacagacttagatccaaatgt

SEQ ID NO: 4484 - DNA, 201 bp, Homo sapiens
ccagggctcttggccagaacagccttctcgctcattaactcagtcaaccaaatgcttcctgtgtttccactggtggttcagaacgtagtctctgccctctratacctcacggtctaacgggggagaaacaagaaagtcagaacttacaatacaagataataaggaataagagcagagcctttggaaccagacagacttaga

SEQ ID NO: 4485 - DNA, 201 bp, Homo sapiens
agataaatacactgttagcccccaactagaagtgtaaaatcattaagacaaaatttgagaatgatacggctcctataatggcaatctttggatgatactgkccaagctgatggaaagtgtaaggactccactttgctttgtaaaaaatacaaaaaaacagccatggaagtgcagtacattttgtatggaacattgtaccac

SEQ ID NO: 4486 - DNA, 201 bp, Homo sapiens
aactaaactacaattgtttggcaccctctcttctccttatcttgcaaaatcaaattaagcactagtggaaagaaacagttcagagaggaatatgggaaagraaaaaaaaaaaccaaaatgtgatttccaacgagactagagatttgttctttatctacatggtcatgttactcatttgatagcatctatctcaggggtatt

SEQ ID NO: 4487 - DNA, 201 bp, Homo sapiens; identical to SEQ ID NO: 1109

SEQ ID NO: 4488 - DNA, 201 bp, Homo sapiens
gcaggctgagtctgaaacgcaggaagtgttttcagatagcacaagtcaacattattttgaaaagggagaaaagtccataaagtttttgagaatagtgtaasaatgtattggtcatcctaactttaatgaatgaacttaagccccctgagcctatcaccctcttttaggatccatctcctttctcggcatcaaaataactgg

SEQ ID NO: 4489 - DNA, 201 bp, Homo sapiens
tgaatctatgaaaagaagaaaagccccgtaagaaatatgctaactgatggtgagggagaaaagggtttagataaaagatatctgaacttgtttggtctcartgattttatgactgaggaattcaattatagatgtactggatggagcaaatcacaattctgtaaattactaataggacacaacgatctttatcattttctg

SEQ ID NO: 4490 - DNA, 201 bp, Homo sapiens
tgtaacaaactctgcttagtaccacagttggagaaaggtttacaataatgcccagtacaaaatgttattcagacttactactcatgcataaaataaaactkgttctcttcttaaacttcgttacatattagataaaacactatcaagttttggcctcatttgttcataatatgtaatttaattcagttgctcagctagttc

SEQ ID NO: 4491 - DNA, 201 bp, Homo sapiens
tttaccaaatgaccactcattaaacctgcccacctatgaacatgaccttataaaatggtgagacatagcagtatctggcactgggcacacagattaccacrgctcaataaaagctgagaaaatgactcagtgattgaacacagcgcattgccatggttgtgtctttaagccattcatgtaattcatgctgtgtattcgact

SEQ ID NO: 4492 - DNA, 201 bp, Homo sapiens
gagataaagttggctactttctctttaaaaggccattacaaacttttacaagcttagaatataatatttgcgtaaaaggagacccagatcctattttaaaygaccaaattattttgatcaaattacttactatagctattttcaatgtctgtattcacaaactgtttactatttcagttctgttttcaagttgacagaaaa

SEQ ID NO: 4493 - DNA, 201 bp, Homo sapiens
acgataggttgctgttaattatatttaccccacagtgctatagatcattagaactattccttgtatctaactgtagttttgtgtctggtaaccaatctctygctatccccagcccttcccagcctctagtagcaactattctactgtccacttttatgagatcaactttttaaacttcgcatatgagtgagaacatgtggt

SEQ ID NO: 4494 - DNA, 201 bp, Homo sapiens
tgccattctcaatttattaggtctttttttgcttttattattatttttaattaacatataattgtacatatttatgtggtacagtgtgacatttcaatacstgcatacaatgtgtaatgatcaaatcagggtaagtagcatatccatcacctcagacacttatcatttttttgtattgggagcattcaaaatctgctcttc

SEQ ID NO: 4495 - DNA, 201 bp, Homo sapiens
caaaatatctgaccctcgccgttcaacagtgtcagaggcataaaagacacatctttgctaaggaatcactacagattaggaggagaatattgcatgacaaytaaatgcaatgtgggatcctggattggatcctagagctgaaaagggacgttagtaggaaaactggtgaaatccaaatagttatagtattgtgccattctc

SEQ ID NO: 4496 - DNA, 201 bp, Homo sapiens
acttgagctgaggagttcgagaccagcctgggaaacatgacaagactccatatctactaaaactacaaaaaattagtcgggcgtgatggcttgtgcctgtrgtttcagctactcgggagtctggagtgggaagatcgctttagcccagggggtggaagttgcagtgagccatgattgcaccactgcactccagtctgggta

SEQ ID NO: 4497 - DNA, 201 bp, Homo sapiens
tgcacctgactactgctattattatcctctttattttagagatgaggaaaataaagtccagagaggttaaacattttgccctaagaccccacagcaagtgkgtagaagacctgggactataatgcaggttttctggcctctagttcagagcattcgtagcatgctagcccctcagtagcatagtactttaggaagctagtc

SEQ ID NO: 4498 - DNA, 201 bp, Homo sapiens
gtagcatgctagcccctcagtagcatagtactttaggaagctagtctttcccacttgctggtagtaagccagggagacataatacactaagaaagcttcgstctgagaaaactttccatgattgttttttctcaatttttagaacagtaggaattcttcacctcatctgctatcccaacatattcacaattggaaaatttt

SEQ ID NO: 4499 - DNA, 201 bp, Homo sapiens
gaaaaggagatttctgagtagaaacacgttagcagaggaaacttcatttggggaacaggattgttttgatgccatgctccctcagctgaccacacagattmcatcctggccagaaaaaggccctgcaaagagctctgatcattttggttctgattccatccttagttcttacccattatctgcttacccttcctccccacc

SEQ ID NO: 4500 - DNA, 201 bp, Homo sapiens
tcggatccacaaaaaaagtagaaataaatgtcagtactgtcggtttcagaaatgccttgcagtggggatgtctcataatggtaagtaaacagtcatcaccwtatactttattattctcattatagctgccagaccagtggacactaaagccattgccaaaaatgtgtacagtttttccaccaaatgccagaatttagaata

SEQ ID NO: 4501 - DNA, 201 bp, Homo sapiens
gtcctctttatttttaataaaattatttagtcattaagaattttggcttgtgggccgggcatggtggctcatgcctataatcccagcactttgggaggccraggtcagaggaccacttgagctgaggagttcgagaccagcctgggaaacatgacaagactccatatctactaaaactacaaaaaattagtcgggcgtgat

SEQ ID NO: 4502 - DNA, 201 bp, Homo sapiens
ctttttttttttttttttttgaggtggggtcttgctttgttgcccaggtgggagtgtcttcttatattggtcaggctggccttgaactcggggctcaagcmgtcctcccacctcagcctcccaaagagctggtattacaggtgtgagccaccagccatggttagttttcatcaactgctttctcaccttcttttcatcctc

SEQ ID NO: 4503 - DNA, 201 bp, Homo sapiens
tgacagaatcgtgtcaagaacctgccttttctgattcccaggccagtatacctttcgctgtaggttgctgcttccatgtgtcataaagacttaaaatttgmttcttttttatccctttgcagggtttcttccggagaacaatcagattgaagcttatctatgacagatgtgatcttaactgtcggatccacaaaaaaagta

SEQ ID NO: 4504 - DNA, 201 bp, Homo sapiens
tcttttcatcctctaattcatacctgcaatccttattagaaatcctgtcaacttaatagtaccagaaagtcaggcaaaagactgataaaaaaaaagcctcrgtggtcaagaacttaaaattacactactggtgtgcaacgtgctcttatctgtgttactggaggacaccctcaagatacctcactccagttgactccttgg

SEQ ID NO: 4505 - DNA, 201 bp, Homo sapiens
ttacccagaacctttggaaaaggaaatgacttgattgaagaggccattctttaaatgtatcttactgctcaatttcaccattgcctattgtagaatgcgcsctgcccgctcagcatttgcctctaggcagaccaggactccttcccctccccaactaatcttccttctcctgtatcttattccctagggccacttgcacct

SEQ ID NO: 4506 - DNA, 201 bp, Homo sapiens
ttcagtatgtgggagaatctgtcctgggcactttatatacacccataatctgtttggatttcttggtaggaagactacatggctgcatacatggtctttcwttacctccattttatagatggagaaaatggaaatttaaagaggttaagcagtttgccgaaggtcacagagctactaatcggtgaggtcaaggttcagacc

SEQ ID NO: 4507 - DNA, 201 bp, Homo sapiens
aagacaggatgtacttgcttgaataggccagtgctttcctggaggaaactccggcttatggagcctctgcttctgcacagcccagtgccttccaccccctsttcatctgctagcatctacattactagttaactggagaggagaccaaacccaaaatattacaaaacatagatattaaaaatactgtgaacaacaatcagc

SEQ ID NO: 4508 - DNA, 201 bp, Homo sapiens
tccaagctactctggaggctgaggcaggaggattgcttaagcccaggaatttgaggctccagtgagctgtgattgtgccactgcactccagcctgggcaayagagtgagatcctgtctcaaaaaaaaaaaagaaaagaaaaagaaaaaagaatctccagattatagttcagatattacgtattaatatccaaagccctcct

SEQ ID NO: 4509 - DNA, 201 bp, Homo sapiens
gctatgtcttttttaaaaaagcaaaaaatagataaacctttgacaaatcagatttttttaatgagagaatgcacaaataaagagctctaagagctgggcayggtgactcatgcctatattcccagcactttgggaggctgaggcaggaggattggttgaggccaggagtttaagaccagcctgggctacgtagcaagaccc

SEQ ID NO: 4510 - DNA, 201 bp, Homo sapiens
caactggtgttcatttgcatgtcaacacccagaattctctgctagttcacctcttcttcagaatgcagaaaggattgaaaaagctggaatggggccgggcrtggtggctcatgcctgtaatcccatcactttgtgaggcagaggtgggtggatcacctgaggccaggagttcaagaccagcctggccaacatggtgaaacc

SEQ ID NO: 4511 - DNA, 201 bp, Homo sapiens
cagtataatcagatatgactagggaaaaaataaaacaactggtgttcatttgcatgtcaacacccagaattctctgctagttcacctcttcttcagaatgyagaaaggattgaaaaagctggaatggggccgggcatggtggctcatgcctgtaatcccatcactttgtgaggcagaggtgggtggatcacctgaggccag

SEQ ID NO: 4512 - DNA, 201 bp, Homo sapiens
ctggtgtttataaagctcattcgttcaatgataaaattggccatagcaaatcaaaaataaatgaagacctctgcgtagctgattggactacagaaaataarccattcatatccaggaagaaaaaattaaaaggattgctgaaaaggaaagagccctaaagcaaactatctacagttttggttagttttcttttcttttctt

SEQ ID NO: 4513 - DNA, 201 bp, Homo sapiens
accaaaattcctaaatgtgcaagtctctgatataaaatggcatagtatttgcatgtaacctacacataccctcctgtatactttagatcatctctagatgrcttataatatctaatacagtataaatactgtataaatagttcctatggccaggtgtcatggctcatgcctgtaatcccatctctttgggaggtggaggca

SEQ ID NO: 4514 - DNA, 201 bp, Homo sapiens
ttcaaaccatctataaattagcagtctaagtggaactttggcaaatgaggttgccaacaagcattttctttatatttagataatttgagctcatggcctcygggcatttggtaagaagtccagtaaagagaagcctaaagaacagaatctttattatgagtagtcgcctttttccactcagcagtttgattccaagcaccc

SEQ ID NO: 4515 - DNA, 201 bp, Homo sapiens
tttaaaaatcaacaatcggccgggtgtggtggctcatgcctgtaatcccagccctttgggaggccaaggcaggcagatcacttgaggccaggagttcaagmccagcctggccaacatggtgaaaccccatctctactaaaaatacaaaaatcagctgggtgtggcagtgcatgccagtaatcccagctacccaggaggctg

SEQ ID NO: 4516 - DNA, 201 bp, Homo sapiens
gcctctgcctcccaaagtgctgggattataggtgtgagccacgcgcccagcctgaagctttttttaaatgaagatttattcaacaaatgtctattgagccmcttatttgtgccacaagctgtttcagataaggaggataaagcaatgaacagacaaattccattcctccttgagtttacaattattgttatctagatttaa

SEQ ID NO: 4517 - DNA, 201 bp, Homo sapiens
ttaagtgatcctcccacctcagcctcccaagtagctgggactacaggtgtgagccactacacccagctaatttttatattttttgtagaaacaggggttcrccgtattgccaggctggtcttgaactcgtaggcccaagcagtcctctggcctctgcctcccaaagtgctgggattataggtgtgagccacgcgcccagcc

SEQ ID NO: 4518 - DNA, 201 bp, Homo sapiens
atagttctgcaaaacttcaaagccatagaaacataagagaataaaactttctacttttgaaacctgtgtctaaagtcaagcttatgactttgggtgtcaayttaagggaaatgatgtagaagacctgagaaaagacccatgttttcatgatctgtggaactaactcagtaaggtcctggaagacaaacgtgtttgaaaaaa

SEQ ID NO: 4519 - DNA, 201 bp, Homo sapiens
ctgcaagcggtgtcttggtgatgggaagttactggtaacagcacacggggtgatggggtgaagaggcttgtgtgcgtgggccccgggggctgaggattgtyggagaggacttctcccaccttctctgggccccaaactgcacactggactggcaagccactctgcccactgcagtgtggagctacaaagcccaagtaggga

SEQ ID NO: 4520 - DNA, 201 bp, Homo sapiens
aaaatcctgctgccaagtcctttatagtaattgcattttaaaaatatgtcttctttattttttattattatttttttttgagatggagtctcgctctgtcrcccagtctggagttaaatggtacaatcttggctcactgcaacctccgcctcccaggttcaagcaattctcctgccttagcctcctgagtagctgggatta

SEQ ID NO: 4521 - DNA, 201 bp, Homo sapiens
caattcctcgccaacctaacagcgtaagtctatttttttctggtggtgtgttattcttctcatagagaactccattttttcattatgacatagcacttatygtttaaacatcaattgatgttcaaacatcagctggtgtaacattgctgcagttgctattgatggataagctgaagtttttaagaaagcaaacccgatgta

SEQ ID NO: 4522 - DNA, 201 bp, Homo sapiens
acaaaaaatttcgaaattagttgggtgtggcggctcatgcctatagtcccagctacttgggaggctaaagcaggaggatcacctgaacccaggagttggargctgcagtgagccatgatcatgccactgcactgggcaacagattaagactctgtcacaaaaaaaaaagcgttaagttaaggagcgtgaataaaaataata

SEQ ID NO: 4523 - DNA, 201 bp, Homo sapiens
caggaggatcacctgaacccaggagttggaggctgcagtgagccatgatcatgccactgcactgggcaacagattaagactctgtcacaaaaaaaaaagcrttaagttaaggagcgtgaataaaaataatacatttcatattctaagacaatatcatctacaactttattccaatataaattactaaaactttaccatata

SEQ ID NO: 4524 - DNA, 201 bp, Homo sapiens
aaaaccataactcttcagatatcatagctctttagatagaaaaatgtaaaagtatttgataaaaattcaacaacattcctgactaaaacaaattaaaattktaaaacccctggaaagccaggagtaaaacatgttctccataatctatagcaaacatcatagttgctgataaaccattagaagcatttccttcaaagttag

SEQ ID NO: 4525 - DNA, 201 bp, Homo sapiens
cccattaggaaaaaattgcttttctaggtgtgtaaagttttgcatatgattatagcctcttacctgtaaaaactgaatcagagcttagaaccatgcctggygcacaatagtcattcaacaattattccttgaataaagagacagtattgtgtggtctgtgaaataacaaaagttcaggagcaacagacacttggtgattct

SEQ ID NO: 4526 - DNA, 201 bp, Homo sapiens
ttgtttttttcttgtaaatttgtttaagttctttgtagattctggatattagccctttgtcagatgggtagattgcaaaaattttctcccattctgtaggytgcctgttcactctgatgatagtttcttttgctgtgcagaaactctttagtttaattagatcccatttgtcaattttggcttttgttgctattgcttttg

SEQ ID NO: 4527 - DNA, 201 bp, Homo sapiens
ggctcaagaattacttaactaaaaaacaccatctcacaaacaatttaaagatggaaagatagaaatagagataggcagacagatggacacatagattaggktttcagattctgttctttctctgtgggagaggtcagcgtgccatgactaccagcctggtctagaacccacagcagccatagttaccaagaccacagcaat

SEQ ID NO: 4528 - DNA, 201 bp, Homo sapiens
tatttctaaggtctgacttcagtctttcaggaaacacctcccaacctccttcgctttcctcctcttggttgtcagattctccacatgaagggtagaacctraggctcaagaattacttaactaaaaaacaccatctcacaaacaatttaaagatggaaagatagaaatagagataggcagacagatggacacatagattag

SEQ ID NO: 4529 - DNA, 201 bp, Homo sapiens
tgagcccagaaggttgcagtgagctacgatcatgccactacactcccacctgcgtgatcgagaaagaccctgtctctaaaaaaaaaaaaaaaattttaaaragagatgggaaaacaacttattggcaatagcacatgttcttgtttgtatgcaacaaacatataaaaagtagaaaaattgaccataagacatagccttact

SEQ ID NO: 4530 - DNA, 201 bp, Homo sapiens
acaaactcctaatgcatgtggcagtacatgtttgctccagctgccctgtccctctaccctgcgtggactccagaaccgcccatgttggagcccacctcctytccccacccctgcccactttccactcacacctcaggcaaaccctgcattttgctgttcctggaaaatggcttatgcttggatacctctgggcctctgttg

SEQ ID NO: 4531 - DNA, 201 bp, Homo sapiens
tgagagtttgaggaggtggtttttatgccgatagttgaagagtgaattggagttaccttaagggggttgtgagaagaaccatgttacagatggaggaaatragatgtgaaggctgtgatgtgggaaacagcttagtttactccctgatttaaatggagaaaaggaatccagtgaggcttcagagagaagcaagaactaggt

SEQ ID NO: 4532 - DNA, 201 bp, Homo sapiens
ggacactcttccctcttggggtgtgtgatgaactcccaggagaggaaagatgggagccagggcaagataggaagctctgcctgagctttccactaggcacrccagccagaccaataaaaagcatctgtcccactctgctaagcctgcttttcttgagcagagggtgagagaggcagtggccatctccacctcagctcctgc

SEQ ID NO: 4533 - DNA, 201 bp, Homo sapiens
atatttaaaaagtaggataaaaaatgtgtgtgaactattgattggaaccttacaaaaatgtatgtatatgaaaaagtctggaagagaatatacaaaagtgrtaatagttatgttacagtagtgagatatggagggctttttgtttgtttttatatttttctctctttcccaaagtttattcagtagtataaaattacttct

SEQ ID NO: 4534 - DNA, 201 bp, Homo sapiens
gtaacttaaatatccaacagtagggagatgtttaaataaattatggtataatcaatagttaaaatattgtacagttataatgacaatttagaaactactcrcaactctgaagaatatttaaaaagtaggataaaaaatgtgtgtgaactattgattggaaccttacaaaaatgtatgtatatgaaaaagtctggaagagaa

SEQ ID NO: 4535 - DNA, 201 bp, Homo sapiens
tggatttgtaaacctcaattccagtttaataatagtagaaaatattcccttcctagtgattgttgataatagttttttttattttaaaattctataatttmaaggattgaagagatttacactcatatatatctgatgtcactaagatttagttcaggttacttagaaagcattgggcaatgttttgtaacttttgggact

SEQ ID NO: 4536 - DNA, 201 bp, Homo sapiens
ttagtgttagaacaaatataatgatcatcatgattaatttttatattgcctcatgcattaaaaacagaattaaaatttacttttgtgtatcagtagtgtcrttctgctttaaatgtaagaaaatcctgaagatgtctgggtctgaaactttaaatggcatatgagaatttagattcatttaattttttttttttttttttt

SEQ ID NO: 4537 - DNA, 201 bp, Homo sapiens
cttgcactgttttgtggtttgggagttgcatattggaggtgggagtggagtgttgagatgaggcaagttgagatgtaatcgctatttaatgggcagatcaragaaaacattggctggtttgatttttattatggttatcccgctccaccatcctggcccagtcatatatattattgttatcaggcatagataggggaagca

SEQ ID NO: 4538 - DNA, 201 bp, Homo sapiens
gtgaggaagaatgaaaacccagcactggttcaaatcactcctagcagaggtagtgaaggcatcactcagtcctggagaaatcttcggagggctcaccagcrtcacaagtaggtagaccagaagaggcaggctggcccattgcaaagccctggaatcagagggacaggagttccaaatccccactctctctcttcctagatg

SEQ ID NO: 4539 - DNA, 201 bp, Homo sapiens
gcttctgagaaatgcaactagaatttcctccggagaagagatggaaacccctgattgagaaatttaaggcctaggaaaggtaaatgacttttcttaagtcwcatggctcaccacagaaccaaagctggaacacacataccctcagctcttcttccagtgctttcaggtatacaagtatttgaacaggattcaaggtttaac

SEQ ID NO: 4540 - DNA, 201 bp, Homo sapiens
tcagttcctctaaaggcaagaatgtattttgaatagagctatcagcagtactgaacaggatggaaatttggtccaactttcctcaacaattgactacatctgctgtatacaactgtagtcatggattgcaaaataatttgctggttcagttccatcagtttcctttttatttcagacctcataaaacataagggcaagctt

SEQ ID NO: 4541 - DNA, 201 bp, Homo sapiens
atccagagttctaaatggacgtttggagaaagtcaaaatgcatgtcaatgaccaaagcaatactaatgcagtgctttttgcaccaaacagggccagatacmtttgaaagaattagcaattaagttttatgaagatgaacacaatagaaatgaataggaatatgatgaacccaaaaaatggagtcagaaaacacgtccagtt

SEQ ID NO: 4542 - DNA, 201 bp, Homo sapiens
aagtacatttcaaggatagtaagccagagaagatatttgaacatctgtaacagacaacagattaatatctagcatattttttaaaaaagtctaaaattcarttttaaggaaaagacagttagaaactgggaagtgaaaagccagggacatacaaatcaagatttaaattcaattttatacatttcagattgtcaaaattaa

SEQ ID NO: 4543 - DNA, 201 bp, Homo sapiens
agctaagtgtagggcttctgaattaagccaggattctcaatagtgtctgaaatagtcataagtcagtaacacccctggctactgaattcctaattcagacyttgtaggagtcccccagtttaaggtcaagaaactagttccaaataatatcagcaagcatgtgagaagctaaccatcttgaatgacattcatcatcaacaa

SEQ ID NO: 4544 - DNA, 201 bp, Homo sapiens; identical to SEQ ID NO: 1103

SEQ ID NO: 4545 - DNA, 201 bp, Homo sapiens
aatccatcttgagttaatttttgtatatggtgtaaggaagggatcaataattctcttatcaaaaaaaccttcctctcctagccatgccaaataactgagcrctctgtgagccatccagctgtcagctagccaagtagcattttcacccactaatattagtctttaaaaagcaagaatcaaaagagaagtcaaggaatatca

SEQ ID NO: 4546 - DNA, 201 bp, Homo sapiens
attgaacagctaaacagaacgaaaaagcatgcacatcttacagatacagagatcatgactttggtagatgagactaacatgtatgaaggtgtaggaagaakgtttatttttcagtccaaggaagcaattcacaatcaactgttagagaagcagcaaatagcgaagaaaaaattaaagaactagaacagaaaaagtcctacc

SEQ ID NO: 4547 - DNA, 201 bp, Homo sapiens
tacaagatatggatttgtaaacctcaattccagtttaataatagtagaaaatattcccttcctagtgattgttgataatagttttttttattttaaaattmtataatttcaaggattgaagagatttacactcatatatatctgatgtcactaagatttagttcaggttacttagaaagcattgggcaatgttttgtaact

SEQ ID NO: 4548 - DNA, 201 bp, Homo sapiens
ggagaatcggttgaacccgggaggcagaggttgcagtgagccgagatcacgctattgcactccagcctgggcaacaagagtgaaactctgtctcgaaatartaataattattattatacatacttaattttatttttgctgaaaatagtatggcaagccagtgcatctctgttagaaatagaaacttagtagccacctcaa

SEQ ID NO: 4549 - DNA, 201 bp, Homo sapiens
cagtgataggaaaagatatatttacccatcattttttttctcttagtcaagacaagtcgcagatcttccttgaaccatttttgacctcaaaacagttattmtgaaacatcaattaaactaagaaatgtaatcacagttcaagttatgagctagtattatcttaatgtaattaaatatctgaatattatcacttcattatat

SEQ ID NO: 4550 - DNA, 201 bp, Homo sapiens
agttgcttgtttccttgctacctgaaaacaaggcctttaaggagtagaaaacagatttggagtttgaaagagggggttaggagagggaaaaataaagttawtgcatgtcccagtttcctcataagccagaaactttgaaacaaaataggaaaataaccatttggaatagcagtgataggaaaagatatatttacccatcat

SEQ ID NO: 4551 - DNA, 201 bp, Homo sapiens
cttcttttctgtctctgtttctctccctctgaatttctgcttcctttcctctctttcccaattgctactgtctctgcctttggttgtctctgagtgtaatmtggaagtgaagtatatttttatctactaaacacatgatcaaatagggattttttattctgaatttaacattaacagaaatgttatgttgctctttatgag

SEQ ID NO: 4552 - DNA, 201 bp, Homo sapiens
tctctgcgctcgaggagcatatagtctagtgaagccgatcaccataaaaacgcatggctgtgataccacatcgtgagtgtaagaacagagctatgtatgcrtggggaacagtggacatgatggccaggtacccttattatgggaaacatagaacccaaagtgtgttcccaaaggaacatgattcaaaataatattttgctg

SEQ ID NO: 4553 - DNA, 201 bp, Homo sapiens
tgggaaaatccaaggtaatattcacagagtactcagatgggaaagttgtcgtgtgctgtcatgtctcatggtagaaatgctacccttagcataataacatrtaaaataactatctctggctgggcacagtggctcatgcctgtaaccccaacactttgggaggctgaggtgggtgaatcacttgaggtcaggagtttgaga

SEQ ID NO: 4554 - DNA, 201 bp, Homo sapiens
ctcagcctctttcactgttaggtcctataaatttttcatttctacctggctttcagagttttcataatggcaacataatcttagtgatagcacgtaatttrctaagccagtttttaggtggcttctggtgtttttattattgtataattatgttttattcttataccattacataccatgaatatctttatgtaaatattt

SEQ ID NO: 4555 - DNA, 201 bp, Homo sapiens
ttgaaggaatatgctatctggggttttctttccattgtatttcaaaatacagtagacaaggacttaatatgtgccagaaattgtactaagtgctgaggatmcaataatgaacaagattcctgcctttgtggagattatatggcaagggaggaaagaaaacattatagattaattcctgtgatcagtgctgtgagataaggt

SEQ ID NO: 4556 - DNA, 201 bp, Homo sapiens
cttggccctcagcctctttcactgttaggtcctataaatttttcatttctacctggctttcagagttttcataatggcaacataatcttagtgatagcacrtaatttactaagccagtttttaggtggcttctggtgtttttattattgtataattatgttttattcttataccattacataccatgaatatctttatgta

SEQ ID NO: 4557 - DNA, 201 bp, Homo sapiens
ttaggctaagtgccctttttatttttaaaattttctgtatttattattactatttttagagatggagtctccctgtgttgcttaggctgggctcacctcakcatctggagttgctgaaactataggcatgtgccactgcacctgacctatttaagaaaataatctagagaagaattgacatgttatttatgaatcattcag

SEQ ID NO: 4558 - DNA, 201 bp, Homo sapiens
ttaaaaaatcaactataaaactaatagcttttggaggaagtaattctttgataagttttcaattatttccattgttaattatttttctgtatcttaagtcracttcaccatttatttcatttcagacaagttagtctgagtaaactgcccttggcctgccttattatttacttaggttctggtaaaaatcccatcccagat

SEQ ID NO: 4559 - DNA, 201 bp, Homo sapiens
gatatggaattaatattccaaaatatgtaagaaactcaacaaactcaattgcaagaaaacaaataacccagttaaaaaatgataaaggaatatccatttcyagaaagaagacatacaagtggccaacagatatatgaaaaggtactcaccatcactaatcatcagggaaatgcaaatcaaaaccacggtgagatatcatct

SEQ ID NO: 4560 - DNA, 201 bp, Homo sapiens
tttggcaccactttgaataatgaactggtgtcaggtaaacagagtccaggtacctattgcagaaagttttccagtctgcaccctcggtggctcacaagttyacatgaagtgaaccaaaagagttttgttgcacttactgtgacaataaatcatgtttagaaaaatgcatgtggcatacatgatattgggcaaatgattcat

SEQ ID NO: 4561 - DNA, 201 bp, Homo sapiens
tccagtcagcctctagctcaccaggaaaccctgagcaggtcactttgcctcattttctttatctgtcaaatgagaactcagatgatctcaaaacagccttktctgctgtagtgtttcaggatgattcttgtctctggatgtcgctgtcatgatgggagaggaattagtaaattcccaggtcagtttacactgcagagtgat

SEQ ID NO: 4562 - DNA, 201 bp, Homo sapiens
atgataactatatgtttaaaaaatgggaaaaaagagatagtcgcaaacttcaacataggttagatcatcatttctcaaaccatattccatcacatattaarctcctcaaatattgcacactgtgcttttttctctcttttgtgtattctcgtgaacattagcctgttagtttaagaagtctcacagtaaacctatttaacc

SEQ ID NO: 4563 - DNA, 201 bp, Homo sapiens
ttcacaatgtagttacttgtaatttggggttaaatcagttgtctgtgcttacattgtagtaactgaaagtgctgcttaaggttgagccaagcagtgtgctmtgattctgtttcctctcctgcttagctatttacttttctggagttaatttttgtcacttagtcattgctcattttgttgtcatttcttgctatgtactca

SEQ ID NO: 4564 - DNA, 201 bp, Homo sapiens
attttccagatgattgcatgataattccttttaagaggactttaacacatgtaagaaatagagttactccctctgttaggagaaatcatggaaagatattrtaattaaaagatagtgaattttagcttaatttttacctttatctaaataacactcgtacacagctacagctttcagtgaagaagagatactcattcccac

SEQ ID NO: 4565 - DNA, 201 bp, Homo sapiens
tgggtgtgatggattacattaatttgttttctaatgttgaaccaaccccacataccttagctaaatctcacttggccatggtgtataattcttttcatacrttatcggattcaatttgctgatattttgttaaagatttctgcatgtctgtccatgagagattggtctatagggtttattttccttgtaatgtctgttttg

SEQ ID NO: 4566 - DNA, 201 bp, Homo sapiens
taagacttctagtatgatgttgaaaagcagtagtgagagaagatatccttgccttattcctaatcttagtgggaaagcttgagtttctcaccattacttaygatgttaactatatgttttgtttgtagatgttcctaagtttaggaagttttcttattttgtcaaattctttttctgcatttattgatatgatcatgtgat

SEQ ID NO: 4567 - DNA, 201 bp, Homo sapiens
attgagtaggaagtacaaagagttcccatatacttcctgtcccccaccacgcacaatctcccccactatcaacatcctgcacccaagtggtacacttgttacagtcaataaacccccactgacacatcattatcactcaaagtccatagtctacattaagattcactcttcgtgttatattctctgggtttgtacaaatgt

SEQ ID NO: 4568 - DNA, 201 bp, Homo sapiens; identical to SEQ ID NO: 1106

SEQ ID NO: 4569 - DNA, 201 bp, Homo sapiens
aaaatacagctattctaggatccttgagcctttcataagagataaggttgtgaatcctaagaccctaggaccatttacttagatgatctgctctctggttygtcctctgaaaagtctgcttcgtgaggggtgtgctgcatttgccttgcctaagtggtgtggcacacaactgtactgtcaccttaggcttaataaccatgt

SEQ ID NO: 4570 - DNA, 201 bp, Homo sapiens
agcagtggtggtgcatgcctgtggtcccagctacttgggaggctgaagttggaggatttctcgagcccgggagtttgaggctacagtgagctgtgattgcrttacagcacgacagcctgggccacagagagagaccttgtctcaaaaataattataataataataacttatactattatttttaaaattgtattcttatcc

SEQ ID NO: 4571 - DNA, 201 bp, Homo sapiens
gtctggtattatttcctgttttatgtattccctaagccaaatcatatagtcactgaagaaaagatccatgttttattctatattccacaaatgccaaacayataataagtataatcaggtcttgttgacttattaataccaagctgatctcctaaggtcagagactggaatatatttagcaaataaatacaaaattttagt

SEQ ID NO: 4572 - DNA, 201 bp, Homo sapiens
tatgagtgaatgttgaattatatcaaatgctttcatagtttgttgtggtggtggttgtttttgagacagggtctcactttgtctccaagctggatcatggygcattgcagcctcaacctcctgggctcaagtgatcctcccacctcagcctcttccagtagctgggaccacagcacatcaccacacccagctaatttttaa

SEQ ID NO: 4573 - DNA, 201 bp, Homo sapiens
gtctgcctaacatggtggctcatgcctgtaatcccagaactttgggaggctgaggtgggtggatcactttgagctcaggagttcgagaccagcctggccarcatagtgaaaccctgtctctactaaaaatacgaaaaattagccaggcatggtggcatgcccctgtaatcccagctacttgggaggctgaggcaggagaat

SEQ ID NO: 4574 - DNA, 201 bp, Homo sapiens
tagaaatctatacttctactagaagtgcatgagtgttctagctcttctacaccatcactggtacttggcattctctgtctttttcacgttagccattctgrtgggtgtgttggtatcatattctaattttaatctccccttttctgatgtctaaaaagttaaacactttaaaaagcgtttgttgtccatttggctatcctt

SEQ ID NO: 4575 - DNA, 201 bp, Homo sapiens
gctatgaacattgtcctgtaggtctcttagtgaaggagcgtatgcatttctggtagctatatgcttcagccaataatagagtatgttgagcttcaggagaygttgccaacagttctgaacaggactctagaaatctatacttctactagaagtgcatgagtgttctagctcttctacaccatcactggtacttggcattct

SEQ ID NO: 4576 - DNA, 201 bp, Homo sapiens
ccccctgggttcacacaatcctcctgcctcagcctcccgagtaactgggattagaggcacccaccaccacgcctggctaattttgtatttttagtagagayggggtttcaccatgttggcagggtggtctcaaactcctgatctcaagtgatccgactgcctgcacttttcaaagtgctggattgcagatgtgagccacta

SEQ ID NO: 4577 - DNA, 201 bp, Homo sapiens
cccaggctgaagtgcagtggcgccgtctcagctcactgcaacctctgccccctgggttcacacaatcctcctgcctcagcctcccgagtaactgggattasaggcacccaccaccacgcctggctaattttgtatttttagtagagacggggtttcaccatgttggcagggtggtctcaaactcctgatctcaagtgatcc

SEQ ID NO: 4578 - DNA, 201 bp, Homo sapiens
accagtgttcaatcagcactgagtttgaggagcaccgggtttgggagtattcatctctcttccctgtcccatagctgcccttcaaactcttgagactgttyccagctctaaaatggaaagggtcgtcttctctctggaacaaaagacaggatgtacttgcttgaataggccagtgctttcctggaggaaactccggcttat

SEQ ID NO: 4579 - DNA, 201 bp, Homo sapiens
aagctccctgacagcagctatccatttaatctgccaattgcagtataaaaattggttattaaatgaaaaacaattgtatacctctcacagaggttgtcatrtattactatttttgtcagcattctcacttataactctgttaggataatcctgggaaaatttctaaaatcttcatagctctttcgttaggtacatattcct

SEQ ID NO: 4580 - DNA, 201 bp, Homo sapiens
aaaagaataaagaattagtctaaggcagtggttcttaaaatgtggtcctgggatcgtgagcatcctctggcagcttgttagaaatgcagtttcttggaccycatcccagacctgtggtgggcctagcaatctgtgttttagggactctgctttatacgctgtttgggaactcttggtccaagatgattcttgcaccccacc

SEQ ID NO: 4581 - DNA, 201 bp, Homo sapiens
gaactcctgggctcaaggaattctcccgcctcgacctcccaaagtgctgggattacaggcgtgagccatcgcagcctgcccctgaattccataatttcacrtgtaattagaattcaagacctttttcttgaatattactcttgtccatattaatttttttctgagtatggctctagctttatcatttttttctgacttaac

SEQ ID NO: 4582 - DNA, 201 bp, Homo sapiens
tttatagagacaggatttcaccatgttgtccaagctggtcttgaactcctgggctcaaggaattctcccgcctcgacctcccaaagtgctgggattacagrcgtgagccatcgcagcctgcccctgaattccataatttcacgtgtaattagaattcaagacctttttcttgaatattactcttgtccatattaatttttt

SEQ ID NO: 4583 - DNA, 201 bp, Homo sapiens; identical to SEQ ID NO: 1108

SEQ ID NO: 4584 - DNA, 201 bp, Homo sapiens
ggtgctgttgagtggaggggctttgaacatggcacacaggaaagggttgcccaccctgtcaccagatgggcttgcactgttttgtggtttgggagttgcayattggaggtgggagtggagtgttgagatgaggcaagttgagatgtaatcgctatttaatgggcagatcaaagaaaacattggctggtttgatttttatta

SEQ ID NO: 4585 - DNA, 201 bp, Homo sapiens
ccacctcagcctcactagtagctgggactacaggcgtaccttaccacacccagcaaatttttgtaatttttatagagacaggatttcaccatgttgtccargctggtcttgaactcctgggctcaaggaattctcccgcctcgacctcccaaagtgctgggattacaggcgtgagccatcgcagcctgcccctgaattcca

SEQ ID NO: 4586 - DNA, 201 bp, Homo sapiens
ccttcaaaacgagtctctcctgagataggagtgagtgattgattgcatgccatttttattgagggatacttaatctgtggttacatatctccaggcaactrtatattcagaaacatttagataactgaccaaagttttcacctttccagaagtttaaagggacccatgtagtaccagggaatataaggaccagtcctttgt

SEQ ID NO: 4587 - DNA, 201 bp, Homo sapiens
attaaaacattatattttgtaccaataatttaacccttgtcttatagggtctctggctactacttcttcataagcactgtttctctgttaaaaatgtgagytcctaaaggcccaagacctatgattgttactcctattgcattttgtaaatgacctttaaataattactccacctcttccaaaacagacagacttaaaaat

SEQ ID NO: 4588 - DNA, 201 bp, Homo sapiens
ttgatcttttgctagatagagacaaaatatcagtgtgaattacagcaaacccctattccatgctgttatgggtgaaactctgggagattctcctattgacscagaaagcgattccttcactgatacactgtctgcaaacatatcacaaggtaaagttccttccagatacggctattggggacgtgggggcatttatgtaag

SEQ ID NO: 4589 - DNA, 201 bp, Homo sapiens
gacaaattagcaaacccaagttttgctttaacttggattgccttaataaagatgttttggggcttaatggcacagttgctcaactcccccactttattccrtgatgttcagacccagccagcatttccccatcaggctcttgcaccatgattgacagggacacttttactagtccccttgaagaatgaatagttactcaat

SEQ ID NO: 4590 - DNA, 201 bp, Homo sapiens
gctacacaaggtcttattcatctctaagttctgtaatttcaaaatgacactttgaaacactctggcaagagatgctttcatttaaaacactaaaacccgtycgttctgtaatttaaaccaagttaaaatatttatgaccttatatgaaatcattgtattaagtcagttatctaagatcttgatgagtagtaagaacatgtc

SEQ ID NO: 4591 - DNA, 201 bp, Homo sapiens
gctcctgctcctttctccctctttctctcccccaggatgaatcataagttaacgaatctgtcatcagttattcatagtactttctctggacacaaacacaygtagggatgtgtgttaataaaaataggaagaaaagtaactttggtcaagagtcaagaaagggtttccaggctcccacaagagccctcccccagcacctcc

SEQ ID NO: 4592 - DNA, 201 bp, Homo sapiens
cgtcatgccactgcactccagcctggatgacagagcaagactccatctcaaaaaaaaaaaaaaagaaaagaaaagaaaaggagatttctgagtagaaacaygttagcagaggaaacttcatttggggaacaggattgttttgatgccatgctccctcagctgaccacacagattacatcctggccagaaaaaggccctgca

SEQ ID NO: 4593 - DNA, 201 bp, Homo sapiens
tctacctagcacctagctttaggcttgccacatattatattggcaatgaatatttgttgaacaaacaaatgcatgaaatgtaatgagtaagacaggttttygctttcaagtaaaacatagtctgggggaagacggaatgtcagaatgtggtgggtgctataggagtaggtgttatcagattctgatgctatggaataataa

SEQ ID NO: 4594 - DNA, 201 bp, Homo sapiens
cattctttctcctgctgaggatgtggtggtgtactcaaagtcacatccatacccttctgtctccaaagtcctaggagagatggccctcttctcaacctctrcattgcacagaaccttacatccctcaacagaaggagtacatagtgcataaggaaagtggtcttttaccactcctcctcactctgtaacattaccaaggac

SEQ ID NO: 4595 - DNA, 201 bp, Homo sapiens
aattagaaaggcgtggtggtgagcacctatcatcccagctactcaggaggctgaggcaggagaatagcttgatcccgggaggcataggttgtagtgagccracgtcatgccactgcactccagcctggatgacagagcaagactccatctcaaaaaaaaaaaaaaagaaaagaaaagaaaaggagatttctgagtagaaac

SEQ ID NO: 4596 - DNA, 201 bp, Homo sapiens
aagaaaatggatgctattatcagttcgttaggtctctaaactccttcttgaatgatacatgtgatatggatgtgctgttctttcattactctcatcatcarcaaaaacaatatgtgtgttttaatgccaaccagggactctgctaggttctagggatgcaatgagatctaaatgcttaaccttttagaagctagcataaat

SEQ ID NO: 4597 - DNA, 201 bp, Homo sapiens
cacttgaggtcaggagtttgagacaagcctggccaacatggtgaaaccctatctctactaaaaatacaaaaattagaaaggcgtggtggtgagcacctatsatcccagctactcaggaggctgaggcaggagaatagcttgatcccgggaggcataggttgtagtgagccgacgtcatgccactgcactccagcctggatg

SEQ ID NO: 4598 - DNA, 201 bp, Homo sapiens
ttcagtccaaggaagcaattcacaatcaactgttagagaagcagcaaatagcgaagaaaaaattaaagaactagaacagaaaaagtcctacctggagcggrgcgttaaggaagctgagaacaacatccgggagatgctgatggcacgaagggcccagtagggagcctctctgggaagctcttcctcctgcccctctcattc

SEQ ID NO: 4599 - DNA, 201 bp, Homo sapiens
aataaggaataagagcagagcctttggaaccagacagacttagatccaaatgtcagctctgcatttactagcaagtggtctatcttggtaagatgcaactyttttctctaagtcttaatttctccctctgtaaagtatgacctcatggggttattgtgaagattaaatggcatatcgtatataaggcccttggcacgatct

SEQ ID NO: 4600 - DNA, 201 bp, Homo sapiens
tgtgttctgatttagaacacatgctcaggatgaggctacaaaaacattctctccccaagtagtgggacttttctcttgtgacttacactcctaattttagmctaatattacatagttggaatttccagaggggttataaagaataagaaaattgctaatttgagtctgtagggagtgggttgggatattttcatcccctcc

SEQ ID NO: 4601 - DNA, 201 bp, Homo sapiens
taaaggactgagtgtgcgtggagcagaaaggggaaagagactagtggggagctggtgaccagttggagggtggagggtagggaacaaccctggcagatccmttttgcccttgactagagcttaaagaccaaaggaagcgttcttgtttttaagtaagtcaggtgttctaagtttaatgttaatatgctttttcaattagat

SEQ ID NO: 4602 - DNA, 201 bp, Homo sapiens
gttgagggagtaaggaagggtaggagttcttggtattcccttatctcttcctttccctccccttatcctgcccagagcatcgcagggtagagccaccagayggattcagggcatggagatggcaggttagtggtagacttggaagggatcgttcttcctatttcagcaccacccttcttcctctacctcccaccctgcatt

SEQ ID NO: 4603 - DNA, 201 bp, Homo sapiens
tgtgaagcctctggcacaatgcctgggacatgttcagcacacaataaatgctaattttcccttttgccctatatgatatgatttgaagcagcgccactcartcctgccagtcacattgctggaaatgccaccaacagtcattcttaagatcgcttattacaatataaatacccctaggggatatcagctaatcgctttatc

SEQ ID NO: 4604 - DNA, 201 bp, Homo sapiens
ttatctctctgagccttaatttccttatcaggaccctgagcaaaccaaataacatgatgtgaagcctctggcacaatgcctgggacatgttcagcacacartaaatgctaattttcccttttgccctatatgatatgatttgaagcagcgccactcaatcctgccagtcacattgctggaaatgccaccaacagtcattct

SEQ ID NO: 4605 - DNA, 201 bp, Homo sapiens
catagttcctgtcccctatctgggctacgattgtgtctgagagtaatagcacttatttattaactggaagaaattttacaggcacctatgttgtttctgcmtagcttctgaggctcctctcttaggccactcctctcaccatgcccccacagctagttggtaaaatggctttgaataatgactcgctttgagttatctaga

SEQ ID NO: 4606 - DNA, 201 bp, Homo sapiens
agaccaaacccaaaatattacaaaacatagatattaaaaatactgtgaacaacaatcagcccgctttctcccacctctcctgtaccagctaaatatttacmtccctcatccgtagagggtttttggacaagacaggctggtgcctacatggtgaaagttgtttttctctcttttcttgtaatattgcaaataaacaaggat

SEQ ID NO: 4607 - DNA, 201 bp, Homo sapiens
tatgaagaaaccctgaactgatgcaaccaccacttgaaaataaagttccaagccaatctgaattgcactaggaaaaggcagccattcttttgggtagggggagaagtgagcttggctggtcattctggttgttagcaattatctggcttccgtgggagcatcatccagaaatttacatcttattgaaacaagaagaaaatg

SEQ ID NO: 4608 - DNA, 201 bp, Homo sapiens
gtcatgtaagatttaaatatttgattataagaattcataatataattttgaaagcctactctgttccagacgctgatttatttaaatcatctctaattctyacaactccgaaaagataagaaaacagagatgtgacaaggcttgaatgcaaacccaggtctgtttgactctttgttcattttgaataaagacaaattactc

SEQ ID NO: 4609 - DNA, 201 bp, Homo sapiens
gctttcaaatacaaagatttaacatatgtaaactgtattgtacttcatttgaaattcagtatctttactaaagagatttcttttatcctatcctacacacrtacagtattatttaatgatgtgcacacagaactctgccagcctgaaacagtaggtctaagacacgtttgttgtttttggctcccctgtgttgatctaaat

SEQ ID NO: 4610 - DNA, 201 bp, Homo sapiens
ggaagtacacatcccctatggtatattcaagcctaaaatgtttaacttgaatccagaaatccttggatatagtgtccagtttataagaaacacaggggatrgagaatcaagctaaatgatacaacaagaaaacaaccagacaaattcagaggttgagacattctatctgataactggcctgacctcttcaattagtcagtg

SEQ ID NO: 4611 - DNA, 201 bp, Homo sapiens
atgtctgggtctgaaactttaaatggcatatgagaatttagattcatttaattttttttttttttttttttttgctgtttattatgcaaagacgagtattsgtttccttcacttcaaggaacgtccatgagttgtggaaagggtaaaacaaattatttttatagttctgcaaaacttcaaagccatagaaacataagagaa

SEQ ID NO: 4612 - DNA, 201 bp, Homo sapiens
gggcattgtggcacgcgcctgtggtctcagctactcaggaggctgaggtaggaggatcgcttgagcctgggagtcagaggttgcggtgagctatgatcgcrctgctgcactccagcctgggtaacagagcaagaccctgtctcaaaaaaagaaaaaaaatttcctactaataaatgtggaaagagtggtggaattagaaaa

SEQ ID NO: 4613 - DNA, 201 bp, Homo sapiens
taagaaaatcctgaagatgtctgggtctgaaactttaaatggcatatgagaatttagattcatttaattttttttttttttttttttttgctgtttattaygcaaagacgagtattcgtttccttcacttcaaggaacgtccatgagttgtggaaagggtaaaacaaattatttttatagttctgcaaaacttcaaagcca

SEQ ID NO: 4614 - DNA, 201 bp, Homo sapiens
tacctcctaatgattccccctccctcaaatactctaacaaagcccctttattcagcatggcatatgtggcatattgcttgtctgactaattcttgctcacrcaagcttcctgaccttactgcataggtctttcaggtacacagttctcaaagtgttgatctgaaagttccgtacaagactggctccccatcactcattaat

SEQ ID NO: 4615 - DNA, 201 bp, Homo sapiens
gtctttcactaacaagaacttaaatgttagaaacctcataccaaattttaatagtgtcccagaaaactacatatagtataataccatttaataaagcctcmaaacaagcaaaattaaatagtatattattttgttttacatagtatgtgataaagctgtattttcttccttttttttttttttttttttttttgagacaat

SEQ ID NO: 4616 - DNA, 201 bp, Homo sapiens
ggtcagaagacacagctgaaaaaatacttttagtggaaccaaagaatggatccagtaactacagtatcgtggattctagctttgactttgtcactgactgyacttgggcaaggcctgggcaagtcacttaacctctttttgctttggtttccccatctgtaaagagggtgttagtttaaatgttctccaggatttcttgca

SEQ ID NO: 4617 - DNA, 201 bp, Homo sapiens
tgcataggttatgttcaaatactatgctattttagattagggacttgagcatcttggatttttgtatccacaacgtcctggaaccaatccttcatgaatamggaaggacaaataaatatatccttctgcctcttcagtcttaaagttagctaaaacatttcacttccccatgccaactctgtgaataccagatcttagatc

SEQ ID NO: 4618 - DNA, 201 bp, Homo sapiens
ctctgcagcaggcaaaagctctttttgttaattcaaaacagtttggaatccatttcagttcttcctaaacctccaagatacgggggaggaaattcactggrttttacaatatatttttcaaggcaaattgccatcgccgtcctaatgacagagaagctgccgatatcactacaacggctgcagatggcaagtcatccagcc

SEQ ID NO: 4619 - DNA, 201 bp, Homo sapiens
gtgattgttttctcctctgcaatttattcgaaagtctatcagttactttggtggtttcagaaagaagtgcttttgttggggatccagttggcctcattctragctggctgtggattcacagaagaacttcacttcagcaaaggctcttagggccccagactaaaagaaagatgagcaagatgtgcgtcatctaagagtggg

SEQ ID NO: 4620 - DNA, 201 bp, Homo sapiens
agtttttcctcctattccagattttccattcagctaagcaggaggctttcatccactaaacaaatttctgatcctacccagtcttaacaagagtgattgtkttctcctctgcaatttattcgaaagtctatcagttactttggtggtttcagaaagaagtgcttttgttggggatccagttggcctcattctgagctggct

SEQ ID NO: 4621 - DNA, 201 bp, Homo sapiens
gccctcaggataaaatagaattaacaaagtcctatttttcctatcaagaagtttacatgcacactcatgtagatagatacatacatacacatatgtgtacrttcatagcagtttgtattcctacccacatatacgaagggaagcatttgaaatgagccattcaaaggtacttagtttctactaggcaaggtctagacaaga

SEQ ID NO: 4622 - DNA, 201 bp, Homo sapiens
aagctactattttcatttaaccagtattgccatttcaatcaggggaatattcaagaatcataattggtggaagatggtaaaaaataaaacacaaacacacytaggttaattaaatggtggtcattcattttttggtagatatcttccctgagaagactgcatcatatttggtaaactgcaggatgtttgtctacagctaag

SEQ ID NO: 4623 - DNA, 201 bp, Homo sapiens
ggtcagggaaatgctttgaacttggcttcgtgactaacctctggtttccattttgctagatctattcttggatagaatttataactgagaggcatcctgayatgcttacaaaaatccacattggatcctcatttgagaagtacccactctatgttttaaaggtatgttgtggggaaagttgttgatctttcactgtgaggg

SEQ ID NO: 4624 - DNA, 201 bp, Homo sapiens
tggtttccattttgctagatctattcttggatagaatttataactgagaggcatcctgatatgcttacaaaaatccacattggatcctcatttgagaagtwcccactctatgttttaaaggtatgttgtggggaaagttgttgatctttcactgtgaggggagggattaattctccagtcgtgtttgttaaaacttgagtt

SEQ ID NO: 4625 - DNA, 201 bp, Homo sapiens
cattttgctagatctattcttggatagaatttataactgagaggcatcctgatatgcttacaaaaatccacattggatcctcatttgagaagtacccactstatgttttaaaggtatgttgtggggaaagttgttgatctttcactgtgaggggagggattaattctccagtcgtgtttgttaaaacttgagtttgtttcc

SEQ ID NO: 4626 - DNA, 201 bp, Homo sapiens; identical to SEQ ID NO: 1151

SEQ ID NO: 4627 - DNA, 201 bp, Homo sapiens; identical to SEQ ID NO: 1153

SEQ ID NO: 4628 - DNA, 201 bp, Homo sapiens; identical to SEQ ID NO: 1154

SEQ ID NO: 4629 - DNA, 201 bp, Homo sapiens
aagaaggcttgggcagaggagaaactgacctgtgatgtaatcacaactatggcctcacctgttcctgtggagagccttgaggctgggttggcctggtaaakttgtcccaaactggggcaagcaggcatgcctttgtaacccctgtttattagtcactgggtgtggattgtaccttggaggaggcatcatgttgggcagcac

SEQ ID NO: 4630 - DNA, 201 bp, Homo sapiens
tttcaagttatctttgaagggattcagattggcaagcacaagagtcagaccctatcctgagccctcaactgtttgcaggaaggaataatctcttgtgtcasatgcagcttgctggggcttcaccttgtgaattagggacagggggagaagtgttggaaggcagcctaccatctcaagtgatgcaaattataatctatcaaa

SEQ ID NO: 4631 - DNA, 201 bp, Homo sapiens
tgtctgttcaagagagcagctagactgagactagactcttagtattgatttcaagttatctttgaagggattcagattggcaagcacaagagtcagacccwatcctgagccctcaactgtttgcaggaaggaataatctcttgtgtcacatgcagcttgctggggcttcaccttgtgaattagggacagggggagaagtgt

SEQ ID NO: 4632 - DNA, 201 bp, Homo sapiens
ggccttgaacgtggctacccaggttgtctgtttgtattttgtttatgtagaatcgaatgtggagaaagaaccgttctttctatgcgaacaatcattgcatyggaacagacctgaataggaactttgcttccaaacactggtgtggtaggttgttggctttatttcttgcaatgtctcttcactgaaagggtgatgttcaca

SEQ ID NO: 4633 - DNA, 201 bp, Homo sapiens
cggcctcctaactttttaaaaagtatgtttctttgattctggatccaaataaggctcttacattatgattggtttatatgtcttttaattctattttaatscatgaactcacattccatcttttgctctttctctctcttctttttttccttgcaatttatttgtcaaagaaaagagtttcccattatcaggatttgctaa

SEQ ID NO: 4634 - DNA, 201 bp, Homo sapiens
caaagtgggcaggcagcacttataaacagcaaatggaaatgaggtccagaagcagcttgagtagttacaggtgagcagttgtcttactgggcataggctgmtcagttggccacatgggattggctgtagcttggctgctgtgattggctgagactcacctcgttagtacaaaaaaaaaatactcctaagttaggttgcagt

SEQ ID NO: 4635 - DNA, 201 bp, Homo sapiens
ggtttaatttgcagataactcaattctatgggataatagggcaatataccaatctcctgaggcttgtggatttctatgttatgccggtggttaatgtggayggttatgactactcatggaaaaaggtaggagaaaaggcaaagaagacaaatcatgttctccttggggatataggatatacaggttgaattattcatagaa

SEQ ID NO: 4636 - DNA, 201 bp, Homo sapiens
tatggttcgattgtctgccttcattaactaggaatactggaccacgtgtaaggcatttatcaccacttcgtagcaccctaagttcagttcttttgaggaaytagcactctttctgaaagttaaatctgcaaatctaaacatgccaaatgacaaattaaaaaaaagaaaaagaaacacactaagtttagaagaacttaaaac

SEQ ID NO: 4637 - DNA, 201 bp, Homo sapiens
ccatgaggaactggtaagtgctacttaattatttttctcattagcattttggaaataaaataatacttagttgaagaatcaaaaactgggaaaaattttgkcctctagaaggcaaatgatagatgttttaaatcatggtgtgatcctgttgagagtcaccctgggtcagtgttctctaagggaatataaagaacgtgcctt

SEQ ID NO: 4638 - DNA, 201 bp, Homo sapiens; identical to SEQ ID NO: 1132

SEQ ID NO: 4639 - DNA, 201 bp, Homo sapiens
aaaaaaaataaaaaataaaaaataaataaataaataaataaaaagcacattaagagagaaaaaatgtaaatcttattggaagcctttttaaaaaaaggaamaatgacatgatgataattacaagaacatgaaatttttattaaataaaatcaatgtttaatcaactttctttctagaaaaaattttgtttcctttcaaata

SEQ ID NO: 4640 - DNA, 201 bp, Homo sapiens; identical to SEQ ID NO: 1134

SEQ ID NO: 4641 - DNA, 201 bp, Homo sapiens
cacaatttgatactcccttagcactttttagtccaagatactgtatgtttgggttcatggcaaaagatgcaaggattcttgaaggattgtagctaggcttygacaaatcctcatcccagatgctctccagacagtggaagtgttacatcaacagccccattcttgggaagggactaatttttaggtagtagcttgtttctt

SEQ ID NO: 4642 - DNA, 201 bp, Homo sapiens
cagaggaagaagcagttcatcccgacttaggttccagggaatcatttagtggtttctccctaaaaaaccactcgtgttcccagaggcccaaagtttgctgyggcactaataacatgccaggggctcacaggaacagcagccatgtaaaaagaatctaagtaaatagagctgacagttactcagcgctgagccattgacata

SEQ ID NO: 4643 - DNA, 201 bp, Homo sapiens
tgtaaccagtaggcaatatctcctcatccctaccttctccccagcccttggtaatttcttatctactttctgtctctatgaatttgcctattatagatatytcacagtgtgcttggttccatgtctatagatcaaagaatgcttgagcttggagggatccagtggcccaagttccttcctggtacagatgaggcccctgag

SEQ ID NO: 4644 - DNA, 201 bp, Homo sapiens
atttgtttgattttacaacagtcttctcccttccctctataccagtggtcctcaacccctgggctgcagacaggtaccagtccatggcctgttaggaacgmggccacgcaactggagatgaatagccagcgagcaagcattactgcctgagcaatgcttcctgtcagatcagtggcagcgttagattctcataggagcaca

SEQ ID NO: 4645 - DNA, 201 bp, Homo sapiens
cagacaacttaagattttctttgcattgagtagattaagctaggtagttctctttgactatacaatttgacgattagtggccaatgccattgggctttctyacttactatcctgttaaatattgctagctccaagttaggaaaaaacctcctggagtggttcaaatgacaatctaaatatctaactctttctttttcttat

SEQ ID NO: 4646 - DNA, 201 bp, Homo sapiens
atctatccaacttagaccacctctctccagcatccatcagcacgactgcatgagcaaacttgatgcagagaggcttcataggtgggatttcaccttcatayaaggtgaaactgtcactgctgtgataagtttggtggggagaggggaatgccataaacagaagtatttttaaatatttgttaaaacatattttaattattt

SEQ ID NO: 4647 - DNA, 201 bp, Homo sapiens
gctagaaatgtcagagcgaatgtggcagatggtgaaaaaagagatagagcacactagaataaaaatgctatgtaaggctagaaaacccactgggtgactaygctactccaagggcccagagaacattctgtttatgaaaataataaggaatgtgctggtgagatgagagggttaccagcatcactgagaagcttgttagtg

SEQ ID NO: 4648 - DNA, 201 bp, Homo sapiens
ttaacaatatgctgtatagcctcttattctgaagaatggttaccaccaagaatatccagattgcatctcctaaaatgacagtatttacttcatagggctgstgtaagaattacatgagatgtggcaaaaatcttagcagagttcctgacgtacagcatgtgctccacaggtgtcagctggtagtattactatttttactgt

SEQ ID NO: 4649 - DNA, 201 bp, Homo sapiens
ttgcgaagggagcttggggaggaagtaagcgttctgtgaattggtgtgggtatctggggaaggcattgagcggacccgtaatgcggaggcccgggttaccyccccccgtctttgcttgagtcactgggattttgagctttccttgagcatcccacccttaactctgcaatagccccctgtgctcaggcgtaatttctcact

SEQ ID NO: 4650 - DNA, 201 bp, Homo sapiens
aaatttacccaaagccatatagctaataaatggtagtcaagatttagaatcaagtaattgggtgcttaacaatatgctgtatagcctcttattctgaagartggttaccaccaagaatatccagattgcatctcctaaaatgacagtatttacttcatagggctgctgtaagaattacatgagatgtggcaaaaatcttag

SEQ ID NO: 4651 - DNA, 201 bp, Homo sapiens
tgattctttatataaaggatccaaaaacacctcacttattaacaggaagtgacatatcaaacctacttactcattttatgctcctctgtattaaaattttktgtgtgtgtgtgttggagatgagagtggagggtaggttgtaggggtgtctttgtcttctcaggctgctataaccaaataccataggttgggtggcttaaa

SEQ ID NO: 4652 - DNA, 201 bp, Homo sapiens
aaaactagctgtttctgaataccataaaatattgccagtattttcaattgtataataacttttttttttttttttttttgagatggtgtcttgctctgtcrcccaggctggagtgcagtggcacgatctcggctcactgcaacctccacctcccgggttcaagagatttttctgcctcagcctcctgagccactgggacta

SEQ ID NO: 4653 - DNA, 201 bp, Homo sapiens
attatagtataattataccttaaaaactagctgtttctgaataccataaaatattgccagtattttcaattgtataataacttttttttttttttttttttgagatggtgtcttgctctgtcacccaggctggagtgcagtggcacgatctcggctcactgcaacctccacctcccgggttcaagagatttttctgcctca

SEQ ID NO: 4654 - DNA, 201 bp, Homo sapiens
gaagacaaatcatgttctccttggggatataggatatacaggttgaattattcatagaattctggatctaggcacaatggctttattattaatttttttttaacttttattgtggaaaatgtcaaatatatatataagtgcacataattgtgtagtaaacttctatctacccatcatagagcttcaacaataattaactca

SEQ ID NO: 4655 - DNA, 201 bp, Homo sapiens
tacctctaaatgaagcatgaagatacagcccaaatcattagttctctggtctcttctttgaaacttccacatgcagctctgacatgactgcataattgtggaggataaaaacagttttaaatcaaagagtcctggcttcaaacttcagtttcaattcacaccagctttgctaccttaactaatgtcacttagtatcaccag

SEQ ID NO: 4656 - DNA, 201 bp, Homo sapiens
tgggaaaaaagcctctgtccctggatttgctggtaagttcgtgagaggttagatgtatgcttctttttgtgtgaaataaagaaataatccacataaaaaaatatgcactcaggaaaatcttgagggagtttttgctccgggtgtgtctccacacctcccggggaagattgccatccaactcacacccatttacctctaaat

SEQ ID NO: 4657 - DNA, 201 bp, Homo sapiens
tgcgaagggagcttggggaggaagtaagcgttctgtgaattggtgtgggtatctggggaaggcattgagcggacccgtaatgcggaggcccgggttacccmcccccgtctttgcttgagtcactgggattttgagctttccttgagcatcccacccttaactctgcaatagccccctgtgctcaggcgtaatttctcactc

SEQ ID NO: 4658 - DNA, 201 bp, Homo sapiens
taattaaatatacttggtttaatttgcagataactcaattctatgggataatagggcaatataccaatctcctgaggcttgtggatttctatgttatgccrgtggttaatgtggatggttatgactactcatggaaaaaggtaggagaaaaggcaaagaagacaaatcatgttctccttggggatataggatatacaggtt

SEQ ID NO: 4659 - DNA, 201 bp, Homo sapiens
gaggtatcttttcatttttttgtgtgttctcttcagtttctttcatcagtgttctatggtcttaattgtaggtctttcacttctttggttagatttattayaggtttttttttttggtcattgtaaatggtatttctttcttgatttttcttttaggttgtctgctattgttgtatataaatgctactgattttgtgtgct

SEQ ID NO: 4660 - DNA, 201 bp, Homo sapiens
ttgaccagctaaaatttgtctttatagttctcctgcctgtacattttgtcattttggggtaaacttctcagtcaccaaatttggatgccattggatcacaytgcaatatgtgccactaagctggatgactctaaagtagagaggaacaagtttgagatgatgtccgttaggaattcatagccagttcctaggaaaagctac

SEQ ID NO: 4661 - DNA, 201 bp, Homo sapiens
gctcacctgctgtgcctgcaatgggccatgtgggaagatccaccctctgcttggaaactagctcactctctgtttcatcacctagtgtcttgctggcagaygtggaagatcttattcaacagcagatttccaacgacacagtcagcccccgagcctccgcatcgtactatgaacagtatcactcactaaatgaagtaagcc

SEQ ID NO: 4662 - DNA, 201 bp, Homo sapiens
aaagtggaaacaactcaaatttccatcaacttatgagcagaaaaacaaaatgcagcatattcatgcaatgaaacatcaatcagcaatcaaaaggaatgaartactgattcatgctacaacatagatgaatcttgaaaatactatgctaagtaaaagaaaccagatacaaaatgccacatatattattccatttatatgaaa

SEQ ID NO: 4663 - DNA, 201 bp, Homo sapiens
aggggaatattcaagaatcataattggtggaagatggtaaaaaataaaacacaaacacacttaggttaattaaatggtggtcattcattttttggtagatmtcttccctgagaagactgcatcatatttggtaaactgcaggatgtttgtctacagctaagaatatctctaactgctgggaataacactttatgctatgga

SEQ ID NO: 4664 - DNA, 201 bp, Homo sapiens
accatctctagtaggacaggatttcagttatgttacttgccatgttggtaaatcgtaccttcaacaaatatttatttgtcgtcaggcaaaatttcttcagycactttgaaaaacaatgtggaagttcctcaaaagattaagtatagagttaccatatgacccagcagttctactcctaggtgtatacccaagacaagtgaa

SEQ ID NO: 4665 - DNA, 201 bp, Homo sapiens
atttcctggtatatctctatataggccccatatttctgcccagctggatcacttctccttccttgagctctgattttacttttctacttgtgcacctgcayttatgatgtttcatctccaattcgtttagcaaaattctgcctatgttagtcttataccatctcatcttcccttcacctattgaatcctagtatctcagaa

SEQ ID NO: 4666 - DNA, 201 bp, Homo sapiens
atggctccatatgaattttagaattttttttctctttctatgaagagtatattgatattgacagggattgcattgaatctgtagattccattcggtagtayggacattttaacaatattaattcttaagcccgtgagcatgaggtatcttttcatttttttgtgtgttctcttcagtttctttcatcagtgttctatggtc

SEQ ID NO: 4667 - DNA, 201 bp, Homo sapiens
tgttgcccatttgtgtgtcttcttttgagaaatgtctgttcagattcctttctcatttttaaaattggattatttgtttttttccttttgaattgtttgcrttccttatatattctggttattaagtccctgttggctggatagcttgcacatattttctcccatttttttcttttcacgctgttatttcctttgctgtgc

SEQ ID NO: 4668 - DNA, 201 bp, Homo sapiens
tcaatcccagcaatcccaaaccagacaataattcaatgtttgctttgaagtgggtgctagcctaaagtcagaatttttttcttttcttttcttttcttttcttttttttttttttttttgctttttccttcccctattatcttgacagaacctcaaatacaactggacttccacccaagagagaggtccagaatcgaacta

SEQ ID NO: 4669 - DNA, 201 bp, Homo sapiens
ggaaacttgatatatgacaaaattgacatagtggatccctgggaaaaatatagatgatgtaaaaaatcataataataaacgatgctaagaagaaaaaaaaagaagtctatttcttctttacactgcacccaaccaaataattttcaattgaatttaaaatttaaataagaaggacagaagaagtatatgagaatatcttta

SEQ ID NO: 4670 - DNA, 201 bp, Homo sapiens
gctgcaattgagattgttgcttggttgagtttgattgtttgctgtcgttttccaggatccatctggtttttgtgggatccagatggcaaattaaatgtggwtttgatgggatctatcatccctgcatcttttaggtctttaagggtggtactgatatttgtcatttcccctcaaggatgaattttttttttttaattttga

SEQ ID NO: 4671 - DNA, 201 bp, Homo sapiens
tctgagctctgaagtgaggcttttcttttatgggctatattgatggtagctttaaaactacaaatatcagaaaaactaaatttacagtggattaaggaaartggggtttattttttctcccataaccataagtctggagacagggctggcatctctgaggatctcttagccactttctcaaggttgcaagggagacaggtg

SEQ ID NO: 4672 - DNA, 201 bp, Homo sapiens
agaattgtagtgagccaagattgctccattgcactccagcctgggtgacaagagcaaaactctgtctcaaaaaaaaaaaaaaaaaaaaaaagtcctatagscagagtcacacatcagaagagtttccagttttgtagaaagagcctcccttagtatccccaccatactcagttattagctgcaagaagccagtgggaaatg

SEQ ID NO: 4673 - DNA, 201 bp, Homo sapiens
cccacgaggcagaattgtagtgagccaagattgctccattgcactccagcctgggtgacaagagcaaaactctgtctcaaaaaaaaaaaaaaaaaaaaaaagtcctataggcagagtcacacatcagaagagtttccagttttgtagaaagagcctcccttagtatccccaccatactcagttattagctgcaagaagcca

SEQ ID NO: 4674 - DNA, 201 bp, Homo sapiens
acccacgaggcagaattgtagtgagccaagattgctccattgcactccagcctgggtgacaagagcaaaactctgtctcaaaaaaaaaaaaaaaaaaaaaaagtcctataggcagagtcacacatcagaagagtttccagttttgtagaaagagcctcccttagtatccccaccatactcagttattagctgcaagaagcc

SEQ ID NO: 4675 - DNA, 201 bp, Homo sapiens
gctttgcagccttgcagtccttgtacccattgttctcttctgtgagcagcatgtcttcgcgtttcagaggtaacccaatagaatcttagactgtggtgggycactctcctcacttgtttgcctcatgtcgtgtcaagtcagtgcactgagctggtggacaaaatggtaaactttgaaggccaggtctttcagaactttcca

SEQ ID NO: 4676 - DNA, 201 bp, Homo sapiens
tgagtgagaacatatcttcatgcatgggctttgttactatttgttgcttcagcttatactctgaaatctgactgatacttatgcttgaaaaaaggaatgaraatgtgactatattttaaccaaagaatatcacattaaaaatatttaatacttttgcatactgcgagggtccctttgcagaggagaggaggtaggaggacc

SEQ ID NO: 4677 - DNA, 201 bp, Homo sapiens
tttgcatactgcgagggtccctttgcagaggagaggaggtaggaggacctcagtattgtagacagatgaatatctgaatcctggttcccatcccttcactrgaaataacattgcaaactactctttctgtgagtaaaaataaatttttttaccaaatgtttctgtgctccacttttccaggaatggcctattcctgaagct

SEQ ID NO: 4678 - DNA, 201 bp, Homo sapiens
aattattaatagaccacaggaagtgttcctctgttgacttcacatactgtttgggtacctggagaccagtttactctctttcactttgttcctactgatgyattgttttcatctcaaagaacaggccaccagtggccttaaaacactgtaatgtgtgcaacaaaattgcagccttgggctatgttccattgttcagagaca

SEQ ID NO: 4679 - DNA, 201 bp, Homo sapiens
ttctactgaatatgcattgcttttgcgctattgtaaagtcaaaaaatcataagtgaaatcattgtatattgcagaccatctctagtaggacaggatttcarttatgttacttgccatgttggtaaatcgtaccttcaacaaatatttatttgtcgtcaggcaaaatttcttcagccactttgaaaaacaatgtggaagttc

SEQ ID NO: 4680 - DNA, 201 bp, Homo sapiens
ggaccaggacagatgcttctttgtctaggttttcacttgcgactccatccttccccgctaagagtcttgcttctacctctgggctcttgttgttgagaacyttccatccctttaggtggccctattggatggcatctaacattaagtgtttcttttcattttaactactactatctagccaactagagaccagccacatgc

SEQ ID NO: 4681 - DNA, 201 bp, Homo sapiens
ctgaagctaaaaaggaaatctaatttcattcagggcaacagactttgataaattgttgctggggttcagaatatcaacccttctaaaaaaaaaaaaaaaaactaacagtctggctttttcttaaagctgttctttgtttttttttttttttttttgtcataatcattttcctactaacagtttttattcatgcagtctctt

SEQ ID NO: 4682 - DNA, 201 bp, Homo sapiens
cctgaagctaaaaaggaaatctaatttcattcagggcaacagactttgataaattgttgctggggttcagaatatcaacccttctaaaaaaaaaaaaaaaractaacagtctggctttttcttaaagctgttctttgtttttttttttttttttttgtcataatcattttcctactaacagtttttattcatgcagtctct

SEQ ID NO: 4683 - DNA, 201 bp, Homo sapiens
tattcctgaagctaaaaaggaaatctaatttcattcagggcaacagactttgataaattgttgctggggttcagaatatcaacccttctaaaaaaaaaaamaaaaactaacagtctggctttttcttaaagctgttctttgtttttttttttttttttttgtcataatcattttcctactaacagtttttattcatgcagt

SEQ ID NO: 4684 - DNA, 201 bp, Homo sapiens
cctcctgggcgcagctgcagctgcccagctggggttgcagacccaggcatttctgcactctcagtgttctgagaaggaccctcattcccctacaggctcgsaagtgcctgctcccactgtctggtctctccgagttcctggtgctcactccaatcttggagcaaaattgaggctgagcctaggtgttgtcacaacctggct

SEQ ID NO: 4685 - DNA, 201 bp, Homo sapiens
ggaatggtggcatgggtatggtttctactgaatatgcattgcttttgcgctattgtaaagtcaaaaaatcataagtgaaatcattgtatattgcagaccawctctagtaggacaggatttcagttatgttacttgccatgttggtaaatcgtaccttcaacaaatatttatttgtcgtcaggcaaaatttcttcagccact

SEQ ID NO: 4686 - DNA, 201 bp, Homo sapiens
tctcaatttatggtggggttatgtctcaatatacccaataaacaatcacaactgaaaatattctaagtaaaaaatgcatttaatatacctaatctaccgartactgaatatcatagcctaaccttccttaaatgtgctcagaacacttacgttagcctacagtagggcaaaatcttctaacacagagcctaatttataata

SEQ ID NO: 4687 - DNA, 201 bp, Homo sapiens
gccactctccatgaattcctgcatattctaacactggaaacaccttttccacccaaggtgtatgatgagatgcaacactgaagctctgcctatttgggacsatttccctctctgctctctttcggtcacccgagtgagtccataatgcagcaccacttcacttttttttttcttttttgagatggagtctccctctgtcgc

SEQ ID NO: 4688 - DNA, 201 bp, Homo sapiens
agaacttgagtaagatgttgatgtgcaggtgagacctcagcaagctttcacataatccactaaaagccattccctgtatttgttagttgaaagaataaatkcgcaggaggactttcttttttatatgatattctccaagtagtaaaaataccttgatgcctttttatgagtatgcagctatattgcctaatataactattt

SEQ ID NO: 4689 - DNA, 201 bp, Homo sapiens
tcccaagtagctggcattacaggtgcccgccaccatgcccagctaattttttgtatttttagtagagatgggatttcaccatattggccaggctcgtctcraactcctgacctcaggtgatccacccacctcggcctcccaaagtgctgggattacaagcgtgagccaccgtgcccagcccacttcattttttacttgtac

SEQ ID NO: 4690 - DNA, 201 bp, Homo sapiens
aaaacattcatcattagaatatcaaagacctgagatggggggaggacctctcttttttttttgagacagagtcttgctgtgttgaccaggctggagtgcaktggcacaatcttggctcactgcagcctctgcctcctaggttcaaggattctcctgcctcagcctcccaagtagctgggactacaggcatatgccaccgtg

SEQ ID NO: 4691 - DNA, 201 bp, Homo sapiens
gaaatttccataggtctctttgggaaaggactgaaggagtcatgatctttttagattctttttttatacagttgcagggtctttccttgtggggacctgaytcctccttcaggcaagaaattctgggtctaagaacagctcagatctggaaaagggcaatggattatgacttttgattaggatagctgtcctcagcctctc

SEQ ID NO: 4692 - DNA, 201 bp, Homo sapiens
aaattatacaaattaactactacaaaaatacaagtaaattagaaaaaaatgggcagttgatctgaataaacataacatataagcaaaaatatgaatggccrataatcaaatataaacaactgtacttcattaataagtcagaaaatgaaaatcaaaatcacaagaaaatttcatttcataaaaatttgattgcaaaagttg

SEQ ID NO: 4693 - DNA, 201 bp, Homo sapiens
ctttcaaatatctgatgtacacatgcaattttacagttaagccatgaatatagtcattcattcatcattgtctcatcaaatatttatggattatcttgtayattccaggcccttttattttatttttttttagcaactagagttatagaaaggaattttaaaaaactcactgcaaaataaatgtttatattaccatgtgtg

SEQ ID NO: 4694 - DNA, 201 bp, Homo sapiens
tgtattaaccatggcagcatagaagtctctgactggaccaaatggactggtgataaagcctaaggtccagctctgtgatcttggataaatggttcaacccytcatgacctccgtcccttatctaaaatgcaggttagactcagtgattggtaaaggctctcatagttcctttttctctgactctgtacccagactcaggga

SEQ ID NO: 4695 - DNA, 201 bp, Homo sapiens
caggtcaatgggggaaaaaataagaaaaaaaaaaaaagaaagaaaaggcttttctgcttcttcttcctctttaactgaaaacagcataatacagtgttagyctggattgaacaaaggtacattaatccatatattcatataaaagacactgaagaatcaccattgagtaatgttggtaatggtgggaaacggtggttttta

SEQ ID NO: 4696 - DNA, 201 bp, Homo sapiens
cacgatctcggctcactgcaacctccacctcccgggttcaagagatttttctgcctcagcctcctgagccactgggactacgggtgcctgccaccatgccyggctaagctttttgtatttttagtagagacagggtttcaccatattggccaggctggtctcaaactcctgcccttgtgatgcacctgcctcggcctccca

SEQ ID NO: 4697 - DNA, 201 bp, Homo sapiens
tttactggaaaggaatctcaggatcagcatctgtggaggaatgaaggaagaaggcttgggcagaggagaaactgacctgtgatgtaatcacaactatggcstcacctgttcctgtggagagccttgaggctgggttggcctggtaaagttgtcccaaactggggcaagcaggcatgcctttgtaacccctgtttattagtc

SEQ ID NO: 4698 - DNA, 201 bp, Homo sapiens
ttctacctgtatactttgattcaattaatgtatgattattttttagaaacttctacttgtcatgtttcaaagctgcacattaactgaaattctatatcttkttgcttccagtctctagtagccagtgaagcagttcgtgctattgagaaaactagtaaaaataccaggtatacacatggccatggctcagaaaccttatgt

SEQ ID NO: 4699 - DNA, 201 bp, Homo sapiens
tctacttgtcatgtttcaaagctgcacattaactgaaattctatatctttttgcttccagtctctagtagccagtgaagcagttcgtgctattgagaaaaytagtaaaaataccaggtatacacatggccatggctcagaaaccttatgtaagtatttcttcttatgatcttagagaactttgagctactaaagaaatctg

SEQ ID NO: 4700 - DNA, 201 bp, Homo sapiens; identical to SEQ ID NO: 1143

SEQ ID NO: 4701 - DNA, 201 bp, Homo sapiens
agcaaacttgatgcagagaggcttcataggtgggatttcaccttcatagaaggtgaaactgtcactgctgtgataagtttggtggggagaggggaatgccrtaaacagaagtatttttaaatatttgttaaaacatattttaattattttgttcaaaaaagttatgttttcttacgatatgttcaggaaagagttggaatg

SEQ ID NO: 4702 - DNA, 201 bp, Homo sapiens
tttaggggttggttatttttcccattaataatatagtcttgtcctggtctgtatgtcctaatctcctcccacaaggacaccagtcagtctggattagtacmcaccctaagggcctcatgttaacttaatcacctctttaaaggccctatctccaaatacagtctctagggggttaaggcttcaattctagatgaatcccag

SEQ ID NO: 4703 - DNA, 201 bp, Homo sapiens
cagttccttgttctctgttctactaaacctcatctcaactcctctttagcagatttctcctgtagccatcctctggatctcagaagtaatgttttgctgawccttagacccagaatgtggccatggacagcaacaaggaatgttagaagaagccatctagcaatgtaacttcttaatttcctgtcttctctcatttctcac

SEQ ID NO: 4704 - DNA, 201 bp, Homo sapiens
tttctttatccacatccacattttctttatccattcatctgttgaagaacacttaggttgattctatatcttgactattgtgaatggtgctgtaataaacrtgggagtgcaggtatctttttgatatactgatttcctttcttttggatacatacccaataataggactgctggcttatatggtagttccatttttagttt

SEQ ID NO: 4705 - DNA, 201 bp, Homo sapiens
gcgagggacaaacagccggacaaggctgaagtcctttgcagtagggttcttatgatggtttctactccaatttccacccatttggttatttattttcagtygcaaaatattatgcaagagaaattgattaacctaacttggattggatgtcttctctcttgaataaattgaccttagtaaaggtcagtgaacatagccaca

SEQ ID NO: 4706 - DNA, 201 bp, Homo sapiens
ataagactttgggttaggacttctcaattttaatctgtcgtttacaagaacttacagtgcagactcaaggcagacatatgaaatgttgggtccccttggtyactgagttggtcaatcagattggatccatgtatcatggcatatccacccatgacatttgctttcagccatgttgtgtgtagtccttggaacatacttatc

SEQ ID NO: 4707 - DNA, 201 bp, Homo sapiens
aagactttgggttaggacttctcaattttaatctgtcgtttacaagaacttacagtgcagactcaaggcagacatatgaaatgttgggtccccttggtcaytgagttggtcaatcagattggatccatgtatcatggcatatccacccatgacatttgctttcagccatgttgtgtgtagtccttggaacatacttatctg

SEQ ID NO: 4708 - DNA, 201 bp, Homo sapiens
atttgctttcagccatgttgtgtgtagtccttggaacatacttatctggaacctgtacacgttgaaaaatcatgcattctggatggtttggtcctactctyacttgatcaaggatgtgcagataatgtgagtctctgggattttgccaacttttcggtgtcagaaccagtgccaagaaaattggcccaggacttagaaagg

SEQ ID NO: 4709 - DNA, 201 bp, Homo sapiens
cttgttagtggctttttcacagtcaaaggagatttttctttaaatttaattttcttgaataaatacaagaataggagttcttttgggtttaaaaagtaaayaatacagaaaagcataaaattagggagaaaatactaaaatttcaccatcctggtgaaaatatgaacatgtttgtgatcatcctttcatacatttctccac

SEQ ID NO: 4710 - DNA, 201 bp, Homo sapiens
tgtgcagataatgtgagtctctgggattttgccaacttttcggtgtcagaaccagtgccaagaaaattggcccaggacttagaaaggtcaagtaaagtaaygaatccagacaacttaagattttctttgcattgagtagattaagctaggtagttctctttgactatacaatttgacgattagtggccaatgccattgggc

SEQ ID NO: 4711 - DNA, 201 bp, Homo sapiens
gtgcagataatgtgagtctctgggattttgccaacttttcggtgtcagaaccagtgccaagaaaattggcccaggacttagaaaggtcaagtaaagtaatkaatccagacaacttaagattttctttgcattgagtagattaagctaggtagttctctttgactatacaatttgacgattagtggccaatgccattgggct

SEQ ID NO: 4712 - DNA, 201 bp, Homo sapiens
attatgtagacaatggggttacattaaaacttattttttgaacaatgagatggcataaaataatatccgctgataaatctcttgagtttttcaagaaggtracagtgtataccatgatgctagttccaatttccgaaaagttccagataagtgagaacttcagaatagatttgacaaaatgaatatcaacagacaaaatga

SEQ ID NO: 4713 - DNA, 201 bp, Homo sapiens
acagcacagactgtatttcagccctcactcactccttctgtctggagtcctacctattagataaagaaataggtaacattgttctgggcctaacatcggtmatctctcagagcataactttttgtagaaagattcccatccaaccagaggtaaaggtaggaaggaaatttaaaaagtgaagcagaaaaagaaattcatatg

SEQ ID NO: 4714 - DNA, 201 bp, Homo sapiens
tctcaataagctgttaaagaaaaaatgggcaccccttccttcgggattgtagctatagccacacttgaaggtgtggcttggcacacagcacagactgtatytcagccctcactcactccttctgtctggagtcctacctattagataaagaaataggtaacattgttctgggcctaacatcggtaatctctcagagcataa

SEQ ID NO: 4715 - DNA, 201 bp, Homo sapiens
tgtcagaggcttggggaaatggcaggagggaaaggggagtgagttataatgggcacaggcatggggattttttatgatgaaatgttccaaaaatcagataytagtgatggttgcaaaactctatgaatacaccaaaaaccgctgaatttcacactttaaaatggtgaatttctggaatgtaaattatatctcaataagctg

SEQ ID NO: 4716 - DNA, 201 bp, Homo sapiens
gtccagaatgggcaaatccacagagacagaaagttcattagtgattgtcagaggcttggggaaatggcaggagggaaaggggagtgagttataatgggcayaggcatggggattttttatgatgaaatgttccaaaaatcagatattagtgatggttgcaaaactctatgaatacaccaaaaaccgctgaatttcacactt

SEQ ID NO: 4717 - DNA, 201 bp, Homo sapiens
actgcactaaaactgaaaaatggaatggtggcatgggtatggtttctactgaatatgcattgcttttgcgctattgtaaagtcaaaaaatcataagtgaartcattgtatattgcagaccatctctagtaggacaggatttcagttatgttacttgccatgttggtaaatcgtaccttcaacaaatatttatttgtcgtca

SEQ ID NO: 4718 - DNA, 201 bp, Homo sapiens
ggtacattaatccatatattcatataaaagacactgaagaatcaccattgagtaatgttggtaatggtgggaaacggtggtttttatggaggtcctgaaartatacctaataggagctactttttctctagtgcccatgtaggctctactgaaagggtttgtcaaccagtttaccacaatgcgagatgtcttacttttacc

SEQ ID NO: 4719 - DNA, 201 bp, Homo sapiens
cagtgttatttaatttggatagccaagtagtcaaaatatattctgttattgtcatcaagaaatgtctcagtcccctcttgggcatggtgctatattgttaygtatcataagagtgaaaaacagaaacagaagcagcaagcatatgggtttttaactaaaaaaaaaaaaaaaaaaccaaataaaaagtaattgtaaggaact

SEQ ID NO: 4720 - DNA, 201 bp, Homo sapiens
tatagatatctcacagtgtgcttggttccatgtctatagatcaaagaatgcttgagcttggagggatccagtggcccaagttccttcctggtacagatgakgcccctgaggctgagacgatgaagtagttgcccaaattaacatgactgcttaatggtaaagcagagtctcgacctcaagtttcctgcctcttcagggctc

SEQ ID NO: 4721 - DNA, 201 bp, Homo sapiens
caatgcttcctgtcagatcagtggcagcgttagattctcataggagcacaaaccccactgtgaaccgcgcatgcaaaggatttaggttgcatgctccttakgagaatctaatgcctgatgatctgaggtggaacagttttatccccaaaccatccccaccactgattccaccccaactctgccccatccatggaaaaattg

SEQ ID NO: 4722 - DNA, 201 bp, Homo sapiens
ctgaggtggaacagttttatccccaaaccatccccaccactgattccaccccaactctgccccatccatggaaaaattgtcttccatgaaactggtccctrgtgccaaaaaggttggggaccactgctctataccctaaactgtgttgtagctgacttttaaaggcaaatacattatgattaattttggaggtgttcttga

SEQ ID NO: 4723 - DNA, 201 bp, Homo sapiens
tgattcttattccagagttagcagcttgtgttagcccaccatactgggaaaaaagcctctgtccctggatttgctggtaagttcgtgagaggttagatgtrtgcttctttttgtgtgaaataaagaaataatccacataaaaaaatatgcactcaggaaaatcttgagggagtttttgctccgggtgtgtctccacacctc

SEQ ID NO: 4724 - DNA, 201 bp, Homo sapiens
gggctggaggaggctgggagagccatgagactgcaatgcaagcttaacccctgtggaggagagaggaaaggaaggaagcaggtagggaacatttcaggtcrtagtgcagttctaagaaagttttggcaaaaccaaccaagagtcctggccaggcacggtggctcacacctgtaatcccagcactttgagaggccgaggtgt

SEQ ID NO: 4725 - DNA, 201 bp, Homo sapiens
ttcgtgagaggttagatgtatgcttctttttgtgtgaaataaagaaataatccacataaaaaaatatgcactcaggaaaatcttgagggagtttttgctcygggtgtgtctccacacctcccggggaagattgccatccaactcacacccatttacctctaaatgaagcatgaagatacagcccaaatcattagttctctg

SEQ ID NO: 4726 - DNA, 201 bp, Homo sapiens
agaaatcccccggattcagccagactcttctggagagacatggggaggaccagctgtagagaggagccacccactccagggtctcctctctgctgagaackaacactcatcaggacaccctggctgcagagaggagctacccaccgcgagtctcctctgagctgttctattactcagtaaagctcctcttcaccttgctca

SEQ ID NO: 4727 - DNA, 201 bp, Homo sapiens
tgttcagattcctttctcatttttaaaattggattatttgtttttttccttttgaattgtttgcgttccttatatattctggttattaagtccctgttggmtggatagcttgcacatattttctcccatttttttcttttcacgctgttatttcctttgctgtgcagaagcaaattttcagtttgatgtaatcccctttat

SEQ ID NO: 4728 - DNA, 201 bp, Homo sapiens
atataagcactatataaatgaaagttattatcctgaagcttattgttactgtttttgctacttttggggtttctttgagcaggtttctggaaaagaacaarcagccaaaaatgccatatggattgactgtggaatccatgccagagaatggatctctcctgctttctgcttgtggttcataggccatgtaagtattcacat

SEQ ID NO: 4729 - DNA, 201 bp, Homo sapiens
cctcttcaccttgctcaccctccgcttgtccacgtacgtcattgttcccgggcgctgaacctgccaaatggtggaggtgaaagagctctaacacaaacagrgctgaaacacgccccttgcttgccacgttgtgggtgacaagaaggagagaagagctgcagccttttggggagctcagacctaagaactccccgaggcagg

SEQ ID NO: 4730 - DNA, 201 bp, Homo sapiens
agcccaggaaggctgccagtcccgtggaccgcagtgggaactgacggtgatttttccgcacccgcctatggccacccatgaaccaatcagcactcacttcytcccatctgaagcccatagaaatcccccggattcagccagactcttctggagagacatggggaggaccagctgtagagaggagccacccactccagggtc

SEQ ID NO: 4731 - DNA, 201 bp, Homo sapiens
ctgcctaaaactaattcagatcatctgactctcttagtacttcaaagcactggaggagggaaagtaaaataaaatatttacctttcaacaattgtgaaggyaggttttatattcaaaaactaaaccacccaaaggcaaattaaaatcttagcttttaagtctctcactcttttctacaactcaataaggatttcaaaaatc

SEQ ID NO: 4732 - DNA, 201 bp, Homo sapiens
gaggtttctgctggtgaagcgaccccagggatcctgtaacaatatcatggtacaaaattgatggctccttgtttgttagtgttttccaagaagcagaggtyaagactagactggaggagcaagcgatgaggggaatgctgttggaggatagaggcgggagctggagaaggcagagagcatcatcagaccatgtcatagctc

SEQ ID NO: 4733 - DNA, 201 bp, Homo sapiens
ttctgtgatggcagggcggcagcctcatgctccccaggcgcagctgcagctgcccgctgcagctacagacctggacatccctgtgctcttgggggccaggrgcaggcaggagccctgccctcctgggcgcagctgcagctgcccagctggggttgcagacccaggcatttctgcactctcagtgttctgagaaggaccctc

SEQ ID NO: 4734 - DNA, 201 bp, Homo sapiens
gctgacacatgacctaaggacactgctccctggtggctccttcaagtagaggggctgctctttttttcacatcaccatgtgctgagaggcctggtggagtrgatcagcattctcttctcctgatactaccaatgatccttctcttctcagaaacttacacaaactggttgcactcttattttattgctatcgtgcactgac

SEQ ID NO: 4735 - DNA, 201 bp, Homo sapiens
atatcccatgaaatggcaattccacttgtaagaaaatgctttcatgtgtgaactgtggctagctacttcaacacagatgataatcttgagaatacaatacygaacaaaagaaaaacaagattcagaagaatacatatagtataccatttttataaagttgaatcaggcaaatctaagggtattgtttcagaattcacacat

SEQ ID NO: 4736 - DNA, 201 bp, Homo sapiens
gatactaccaatgatccttctcttctcagaaacttacacaaactggttgcactcttattttattgctatcgtgcactgaccttcagataatttcctggtayccggttcatgattctttattcccctccaactcttgccatcattctgagtgaattcaaagtccatgtgtgagagtcacctaacaatgtatcttcacagttc

SEQ ID NO: 4737 - DNA, 201 bp, Homo sapiens
tagaatcttagactgtggtgggccactctcctcacttgtttgcctcatgtcgtgtcaagtcagtgcactgagctggtggacaaaatggtaaactttgaagrccaggtctttcagaactttccaagttgccctgacaaataagtagactttagcacaatgggctatcactaaagacagggtcttttttctttcctggctctg

SEQ ID NO: 4738 - DNA, 201 bp, Homo sapiens
agaatcttagactgtggtgggccactctcctcacttgtttgcctcatgtcgtgtcaagtcagtgcactgagctggtggacaaaatggtaaactttgaaggycaggtctttcagaactttccaagttgccctgacaaataagtagactttagcacaatgggctatcactaaagacagggtcttttttctttcctggctctgg

SEQ ID NO: 4739 - DNA, 201 bp, Homo sapiens
cctaactaagccaataatatttctctttttgggagtggaaatggaagctaagttgattgacccacaggaacaagagggaacatgccgttatattttaaccrgtgtgtaaagaaggctgttatgcaatcaatgatctgggtttttctcttcagagaaatttgttgtacagaaaattgctgttgggatgaagctttgcagcct

SEQ ID NO: 4740 - DNA, 201 bp, Homo sapiens
cttgccattgtttattatcatacttatattaatagcattgaactgctgcttttccctttccaacttatcacttctattagctttctgaaggcagagaccargtctaaagtaatttttttgttccccataacctggtatattgtttggtcaacataattggtgctcaatatccccttgtggaatttgaaatttaaattaatg

SEQ ID NO: 4741 - DNA, 201 bp, Homo sapiens
gtatctaaacagtacctactgttgggataaatactttattgtcattggctacagttcaaactatacatacatatatagagattggagtaaaaactgagacrgatagctctctgatatatttgtaatggtaatgaaaatgacattttgttttaaaattttcccttcatgtgtcttatatttttttttagcaaccccattaac

SEQ ID NO: 4742 - DNA, 201 bp, Homo sapiens
accctgacacctctgccctcctattagacatcctaccctctacccaaactgcttgctgaatctttgtaagattaaattatttaatccacaaatatttatarattgcctatgatgtttcagatcctggaaatacaaggatgaacaaaatatagcccaaggatcttatagctgagtattttgctccaacaatgtgaacctgat

SEQ ID NO: 4743 - DNA, 201 bp, Homo sapiens
aggcttgggcagaggagaaactgacctgtgatgtaatcacaactatggcctcacctgttcctgtggagagccttgaggctgggttggcctggtaaagttgwcccaaactggggcaagcaggcatgcctttgtaacccctgtttattagtcactgggtgtggattgtaccttggaggaggcatcatgttgggcagcacagct

SEQ ID NO: 4744 - DNA, 201 bp, Homo sapiens
ttctttgtctaggttttcacttgcgactccatccttccccgctaagagtcttgcttctacctctgggctcttgttgttgagaactttccatccctttaggkggccctattggatggcatctaacattaagtgtttcttttcattttaactactactatctagccaactagagaccagccacatgcaggtttagctttatca

SEQ ID NO: 4745 - DNA, 201 bp, Homo sapiens
ggaatcaatcccaccctctcatcactcagtcttacactcttctccattctcctctattctcatcttctttttcttttatacagaggcttctcaatttatgrtggggttatgtctcaatatacccaataaacaatcacaactgaaaatattctaagtaaaaaatgcatttaatatacctaatctaccgaatactgaatatca

SEQ ID NO: 4746 - DNA, 201 bp, Homo sapiens; identical to SEQ ID NO: 1137

SEQ ID NO: 4747 - DNA, 201 bp, Homo sapiens
gtcacatgcagcttgctggggcttcaccttgtgaattagggacagggggagaagtgttggaaggcagcctaccatctcaagtgatgcaaattataatctaycaaaggaatgaatgaacgttggtctggcaacaaatatcaccatcccattttatttactaaacttactaaaccactttagcaagttaaaagtagcactgaa

SEQ ID NO: 4748 - DNA, 201 bp, Homo sapiens
tggtcactagcttcctacaacagcacaccacagattaagtctcaacacagcactcattgttttggtattagcagcaggaattgttcctgccctgacttccytaaccctcagggttttggtcctattaaagtacctccaattttagcattgaggagagagtctgttttttggaacataacagacaatacaggaaattcaaag

SEQ ID NO: 4749 - DNA, 201 bp, Homo sapiens
cagatttagtcaaagggagttgcaggcagcagttggtttggaaagtagcttggaagagaggttcgggattagaggttcagtctcatggttctcacccactrgcagatctaatcatggccttggcgtcagcccagtgcaattatcctcagctggttgttgcagaggttggcgggcaggtgggctcactgcagaccgccatct

SEQ ID NO: 4750 - DNA, 201 bp, Homo sapiens
tggcccaagttccttcctggtacagatgaggcccctgaggctgagacgatgaagtagttgcccaaattaacatgactgcttaatggtaaagcagagtctcsacctcaagtttcctgcctcttcagggctctttccactaaaatgcttgaaatctctagaatgacaatcatagaatgagaatctgaggctcactgtccagca

SEQ ID NO: 4751 - DNA, 201 bp, Homo sapiens
aactgacccccagtcaagagagctgttgattttgcaattgcttaggagcataaagactgagagtatatgttctcttattacactgaatctgtagtaagatyctctgtcctaataacattttaaattttgtttcccttttgcaattacctaaaagctcctcacagtataatatattccatctttactctttatttaatatca

SEQ ID NO: 4752 - DNA, 201 bp, Homo sapiens
tatgttctcttattacactgaatctgtagtaagatcctctgtcctaataacattttaaattttgtttcccttttgcaattacctaaaagctcctcacagtrtaatatattccatctttactctttatttaatatcaaaatcctcttttatttttttccccagtggccaagttctagctgctcttcctagaacctctaggca

SEQ ID NO: 4753 - DNA, 201 bp, Homo sapiens
aagatcctctgtcctaataacattttaaattttgtttcccttttgcaattacctaaaagctcctcacagtataatatattccatctttactctttatttartatcaaaatcctcttttatttttttccccagtggccaagttctagctgctcttcctagaacctctaggcaagttcaagttctacagaatcttactacaac

SEQ ID NO: 4754 - DNA, 201 bp, Homo sapiens
ccccagggatggcagaaacttctgggttaaggctgagcgaaccattgcccactgcctccaccagcccccagcaaaggcacgccggcgggggggcgcccagycccccagcaaacgctccgcggcctcccccgcagaccacgaggtgggggccgctggggagggccgagctgggggcagctcgccaccccggctcctagcgag

SEQ ID NO: 4755 - DNA, 201 bp, Homo sapiens
gttggtttgtgacttgtggcctagctcatcagatgagccacgagaatcagacctggattttgatctggccctgttctgacatgcaatgaggcatttgtagsatttagtaatattgctagttcaaagaatactagaaatattagtaagaacctattcaaaagtattcatgagtattttctgcatatgaatcaggaattagaa

SEQ ID NO: 4756 - DNA, 201 bp, Homo sapiens; identical to SEQ ID NO: 1163

SEQ ID NO: 4757 - DNA, 201 bp, Homo sapiens
cccaagttgaaggtggctctgtcatcttcaacatgtggcttccaaggttgctctagtattcacctttccagcccatgagaaaggggaaagagagtggcggrttctgagggggtcacatgacaggttctatgcactaggcctggaagacacataccacctttgcttacattctattggaaaatacttcatcataaagccaca

SEQ ID NO: 4758 - DNA, 201 bp, Homo sapiens; identical to SEQ ID NO: 1164

SEQ ID NO: 4759 - DNA, 201 bp, Homo sapiens; identical to SEQ ID NO: 1162

SEQ ID NO: 4760 - DNA, 201 bp, Homo sapiens
tggtaacactgaagttgcaaagcagaagttaaattaactcttgtcagtaagcaatccaggaacacgtcagccagtgtatgctaattgtgccgtaacagggygatttggatatttgtaggggaaatgggtagtaaatatcaagactggtgaccgtaggtcagcccagcacaaaggaagtggagatttttccatgcacaagaa

SEQ ID NO: 4761 - DNA, 201 bp, Homo sapiens
attactaaaatgattcctgtaattccacattctcaagaaaaaatgtgtttaaggtgtaatagtaaattcttataggacttattctagtaagtgggtaaatsgtaaaaatctaaatttgggttaaattttttcgctcaaatacctacatttcctttatcgtaccccaaaaggagctctcaaagagtagtttgaacagttttt

SEQ ID NO: 4762 - DNA, 201 bp, Homo sapiens; identical to SEQ ID NO: 1166

SEQ ID NO: 4763 - DNA, 201 bp, Homo sapiens
gaacgcagccccgagtcaccgtgtccttcgtcctttacccgcctgtgtcaagcctcccaaaatgacccgcagttcagctcgtccttcgccgtgaacgtccstttgcggggttgcggccgccgtcgcccgccaccccttgccccactacccaagccactgcgccgtcgtctccccaaactgccccgcagttccgcgcccgcc

SEQ ID NO: 4764 - DNA, 201 bp, Homo sapiens; identical to SEQ ID NO: 1160

SEQ ID NO: 4765 - DNA, 201 bp, Homo sapiens
ttcagctcgtccttcgccgtgaacgtccctttgcggggttgcggccgccgtcgcccgccaccccttgccccactacccaagccactgcgccgtcgtctccycaaactgccccgcagttccgcgcccgcccgccgcggcagttgcggggtcgggctggctggtgcctcgggacgagaaggccatcaagtgttgctccctcat

SEQ ID NO: 4766 - DNA, 201 bp, Homo sapiens
ctacatattttaatagtttattagcttcctttagaccaagactgtgacctctttattttctaaagcacacacgtagtttagcatatgaggcgataaaataytgatgttaactttttaaatccccagttataaaaattttaaaataacagggattaaggtgagattcaggtttgttgtgtctttaaattgtatatgtgactt

SEQ ID NO: 4767 - DNA, 201 bp, Homo sapiens
cccgaagattttttttttttttttttttgagcaggttggactcttcggcttcctggaagggaaaaataggtcctttagtggctgggctacatctttcaagkaggtattattttaatgaaagactagaggtgttttgtgattttgtttgaaactcgcatccaagagtgtttttcgaaaacagactgaaggagcaagaaaaac

SEQ ID NO: 4768 - DNA, 201 bp, Homo sapiens; identical to SEQ ID NO: 1165

SEQ ID NO: 4769 - DNA, 201 bp, Homo sapiens
ctcagcctctgcactaatgacattttgggccgaataattctgttgtaggaggctgtcctgtgtgttttagattgtttggaattatccctggcctctcacaytagatgccagcagtatcctcctcccccagtgtgacaacctaaaatgtctccagacattgccaaatgttccctgtggggcgggggcaacattgcccactgt

SEQ ID NO: 4770 - DNA, 201 bp, Homo sapiens
aactagttctgggcactgccccctttactgttctctgggtatcaacccctgtccttcaattttagttgaactagtggatggtgataccacaggctcaagayagctgcatttaaatatcagtgaccacaggccacatcaaggaaacatctgcaggcaacccagggcctgggaaggagccattttcagtcacttgtaagacag

SEQ ID NO: 4771 - DNA, 201 bp, Homo sapiens
tcacactagatgccagcagtatcctcctcccccagtgtgacaacctaaaatgtctccagacattgccaaatgttccctgtggggcgggggcaacattgccyactgttaagaactactgctctagaccaaagaacacagcacagaggaaaggaaaaaaaaatccagttaagagaatgttaggtggagatgactatagtcatc

SEQ ID NO: 4772 - DNA, 201 bp, Homo sapiens; identical to SEQ ID NO: 1161

SEQ ID NO: 4773 - DNA, 201 bp, Homo sapiens
tagaacgtaaatatagggagtagtacctcatgagcttcaggatccggaaactgaagagtctttggttgctcggggctgtctgtcttcctaaaactatgtgrtctctcttctctgccccctttgcacatttttttctttcttctgacactctgcagacagacattatctgcatcttcatcacacatgggctgaagatagtgt

SEQ ID NO: 4774 - DNA, 201 bp, Homo sapiens
cagcgcttatacaaaacggcactatagaacctccattttacagcaccatatgaagtgggaaaattaggtgaaaattttcctgaagcaaccttaacatgcgvagcccttgttggtttgtgacttgtggcctagctcatcagatgagccacgagaatcagacctggattttgatctggccctgttctgacatgcaatgaggca

SEQ ID NO: 4775 - DNA, 201 bp, Homo sapiens
cacttccatataagacatgaattccatgagtaaaatcaaacttctgtggcaaggtgaactactctagaatgtctccatttacatacatgtggtagtttggrtgtttatgcatatggatagatgcacatatatagagttcctgtgttgtctagcaattgttttaaaatttggacaattatctaatttctagggtaaggtata

SEQ ID NO: 4776 - DNA, 201 bp, Homo sapiens
agccagctgtgggggagcccgctgaggtcacgaccacggtgctggtgaggagagatcaccatggagccaatttctcgtgccgcactgaactggacctgcgsccccaagggctggagctgtttgagaacacctcggccccctaccagctccagacctttggtgaggattgaagaagccagcagggagaaggtgggggtgggg

SEQ ID NO: 4777 - DNA, 201 bp, Homo sapiens
gccagctgtgggggagcccgctgaggtcacgaccacggtgctggtgaggagagatcaccatggagccaatttctcgtgccgcactgaactggacctgcggscccaagggctggagctgtttgagaacacctcggccccctaccagctccagacctttggtgaggattgaagaagccagcagggagaaggtgggggtggggt

SEQ ID NO: 4778 - DNA, 201 bp, Homo sapiens
ggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacgtgattctgacgaagccagaggtctcagaagggacc

SEQ ID NO: 4779 - DNA, 201 bp, Homo sapiens
acatagcgagaccctgtctctaagaaaaaataaaaaaattagggtacagtggcatatgcttgtattctcaactactctggaggctcaagtgggaggatcayttgaacccaggaatttttttgtttttgtttttgtttttttgagatggagtctcactctgtggcccaggctggagtgcagtggtgccatcttggctcactg

SEQ ID NO: 4780 - DNA, 201 bp, Homo sapiens
atcccttaagcccacgaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgt

SEQ ID NO: 4781 - DNA, 201 bp, Homo sapiens
ctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactc

SEQ ID NO: 4782 - DNA, 201 bp, Homo sapiens
gatcttgagggcacctacctctgtcgggccaggagcactcaaggggaggtcacccgcaaggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtag

SEQ ID NO: 4783 - DNA, 201 bp, Homo sapiens
cagcaccgccccttggcccccaggtggctagcgctataaaggatcacgcgccccagtcgacgctgagctcctctgctactcagagttgcaacctcagcctmgctatggctcccagcagcccccggcccgcgctgcccgcactcctggtcctgctcggggctctgttcccaggtgagtcggggtggggattgccgtcgggcc

SEQ ID NO: 4784 - DNA, 201 bp, Homo sapiens
cagcccccggggtcatcgccctgccaccgccgcccgattgctttagcttggaaattccggagctgaagcggccagcgagggaggatgaccctctcggcccsggcaccctgtcagtccggaaataactgcagcatttgttccggaggggaaggcgcgaggtttccgggaaagcagcaccgccccttggcccccaggtggcta

SEQ ID NO: 4785 - DNA, 201 bp, Homo sapiens
tctcaagtagctgggactacaggcacacaacaccacgcctggctaatttttgtatttttaggtagagacggggtttcactatattggccaggctggtcttsaactcctgacctcaggtgatccgcctgcctcggccccccaaagtgttgggattacaggcgtgagccaccacacgcagcctttttgttattagactctgtc

SEQ ID NO: 4786 - DNA, 201 bp, Homo sapiens
tacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgt

SEQ ID NO: 4787 - DNA, 201 bp, Homo sapiens
tgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaa

SEQ ID NO: 4788 - DNA, 201 bp, Homo sapiens
actgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggg

SEQ ID NO: 4789 - DNA, 201 bp, Homo sapiens
cgaacattcccagcagcttctggaaaccccagggaaacctctttgaaggtcttttctgcatctctgcctgataggtctttttttttttttttttttttttytttttttgacacacagtcttgctctgtcgcccaggctggatcactgcaacctccatctcccgggttcaagcagttctcctgcctcatcctctccagtagc

SEQ ID NO: 4790 - DNA, 201 bp, Homo sapiens
aggcattctgggcaggaggaacagcctgggcaaaagttgggagcagggagaaatcttgatggaggcaggaggaggaggaggtaggttggtgtaggccaggygcagtggctcacacctgtaatcccagtgctttgggaggccaaagcaagaggattgtttgagcccaggagttcgagaccagcctgggcaacatagcgagac

SEQ ID NO: 4791 - DNA, 201 bp, Homo sapiens
ggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtggga

SEQ ID NO: 4792 - DNA, 201 bp, Homo sapiens
cacaagtaaacctcagcctctcaagtagctgggactacaggcacacaacaccacgcctggctaatttttgtatttttaggtagagacggggtttcactatrttggccaggctggtcttgaactcctgacctcaggtgatccgcctgcctcggccccccaaagtgttgggattacaggcgtgagccaccacacgcagccttt

SEQ ID NO: 4793 - DNA, 201 bp, Homo sapiens
cctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtg

SEQ ID NO: 4794 - DNA, 201 bp, Homo sapiens
ctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtga

SEQ ID NO: 4795 - DNA, 201 bp, Homo sapiens; identical to SEQ ID NO: 1183

SEQ ID NO: 4796 - DNA, 201 bp, Homo sapiens
ggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggat

SEQ ID NO: 4797 - DNA, 201 bp, Homo sapiens; identical to SEQ ID NO: 1184

SEQ ID NO: 4798 - DNA, 201 bp, Homo sapiens; identical to SEQ ID NO: 1188

SEQ ID NO: 4799 - DNA, 201 bp, Homo sapiens; identical to SEQ ID NO: 1189

SEQ ID NO: 4800 - DNA, 201 bp, Homo sapiens; identical to SEQ ID NO: 1190

SEQ ID NO: 4801 - DNA, 201 bp, Homo sapiens
accttttgggctcaagtgatcctcccacctcagcctcctgagtagctgggaccataggctcacaacaccacacctggcaaatttgattttttttttttttycagagacggggtctcgcaacattgcccagacttcctttgtgttagttaataaagctttctcaactgcctcagccttgtgtgagttgaggggaggtgtcac

SEQ ID NO: 4802 - DNA, 201 bp, Homo sapiens
gggctcaagtgatcctcccacctcagcctcctgagtagctgggaccataggctcacaacaccacacctggcaaatttgatttttttttttttttcagagayggggtctcgcaacattgcccagacttcctttgtgttagttaataaagctttctcaactgcctcagccttgtgtgagttgaggggaggtgtcacatccagc

SEQ ID NO: 4803 - DNA, 201 bp, Homo sapiens
ctattaaaaatacaaaaattagctgggcgtggtggtgcttgcctgtaatcccagatactctggaggctgaggcaggagaatcacttgaacccgggaggcaraggttgcagtgagctgagattgcgccactgcactccagtctgagtgacaaagcgagactccatctcaaaaaaaaaaaaaataaaagaacacatctttagc

SEQ ID NO: 4804 - DNA, 201 bp, Homo sapiens; identical to SEQ ID NO: 1193

SEQ ID NO: 4805 - DNA, 201 bp, Homo sapiens; identical to SEQ ID NO: 1195

SEQ ID NO: 4806 - DNA, 201 bp, Homo sapiens; identical to SEQ ID NO: 1196

SEQ ID NO: 4807 - DNA, 201 bp, Homo sapiens
aggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcgga

SEQ ID NO: 4808 - DNA, 201 bp, Homo sapiens
agccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggcccccacccaccgagca

SEQ ID NO: 4809 - DNA, 201 bp, Homo sapiens
gtgatcctcccacctcagcctcctgagtagctgggaccataggctcacaacaccacacctggcaaatttgatttttttttttttttcagagacggggtctygcaacattgcccagacttcctttgtgttagttaataaagctttctcaactgcctcagccttgtgtgagttgaggggaggtgtcacatccagctggagtcc

SEQ ID NO: 4810 - DNA, 201 bp, Homo sapiens
catccctgtctgctcacacctttcttctctccctagtcctgccagcgactcccccacaacttgtcagcccccgggtcctagaggtggacacgcaggggacmgtggtctgttccctggacgggctgttcccagtctcggaggcccaggtccacctggcactgggggaccagaggttgaaccccacagtcacctatggcaacg

SEQ ID NO: 4811 - DNA, 201 bp, Homo sapiens
tgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagct

SEQ ID NO: 4812 - DNA, 201 bp, Homo sapiens
ctttcttctctccctagtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggc

SEQ ID NO: 4813 - DNA, 201 bp, Homo sapiens
cattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttc

SEQ ID NO: 4814 - DNA, 201 bp, Homo sapiens
tgactcagaggcgctgttcccgctccacccagagccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcatt

SEQ ID NO: 4815 - DNA, 201 bp, Homo sapiens
accatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggctccgtgttcttcaccgggtgtagggtccttcctg

SEQ ID NO: 4816 - DNA, 201 bp, Homo sapiens; identical to SEQ ID NO: 1177

SEQ ID NO: 4817 - DNA, 201 bp, Homo sapiens
gtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcag

SEQ ID NO: 4818 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagagctgggtgggggcaggggccatggacctaatgcaatcctcaccgcctgttgtatcctc

SEQ ID NO: 4819 - DNA, 201 bp, Homo sapiens; identical to SEQ ID NO: 1179

SEQ ID NO: 4820 - DNA, 201 bp, Homo sapiens
cgtggatgtcagggcccccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgt

SEQ ID NO: 4821 - DNA, 201 bp, Homo sapiens
acgtggcgaaaccccgtctctattaaaaatacaaaaattagctgggcgtggtggtgcttgcctgtaatcccagatactctggaggctgaggcaggagaatmacttgaacccgggaggcaaaggttgcagtgagctgagattgcgccactgcactccagtctgagtgacaaagcgagactccatctcaaaaaaaaaaaaaat

SEQ ID NO: 4822 - DNA, 201 bp, Homo sapiens
agcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccgga

SEQ ID NO: 4823 - DNA, 201 bp, Homo sapiens
ttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcga

SEQ ID NO: 4824 - DNA, 201 bp, Homo sapiens
ccttttgggctcaagtgatcctcccacctcagcctcctgagtagctgggaccataggctcacaacaccacacctggcaaatttgatttttttttttttttyagagacggggtctcgcaacattgcccagacttcctttgtgttagttaataaagctttctcaactgcctcagccttgtgtgagttgaggggaggtgtcaca

SEQ ID NO: 4825 - DNA, 201 bp, Homo sapiens
ccaaggcccaatctccctgaaggtcccataaggtcttgcctccaagtcctgcccccacccacctccatgtcatctcatcgtgtttttccagatggcccccractggacgagagggattgtccgggaaactggacgtggccagaaaattcccagcagactccaatgtgccaggcttgggggaacccattgcccgagctcaag

SEQ ID NO: 4826 - DNA, 201 bp, Homo sapiens
ctggtcaatggcccctatcccccaaggcccaatctccctgaaggtcccataaggtcttgcctccaagtcctgcccccacccacctccatgtcatctcatcrtgtttttccagatggcccccgactggacgagagggattgtccgggaaactggacgtggccagaaaattcccagcagactccaatgtgccaggcttggggg

SEQ ID NO: 4827 - DNA, 201 bp, Homo sapiens
agtaagaaggggcaggggcggagtggggcttcttgggggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagccca

SEQ ID NO: 4828 - DNA, 201 bp, Homo sapiens
ttcttctctccctagtcctgccagcgactcccccacaacttgtcagcccccgggtcctagaggtggacacgcaggggaccgtggtctgttccctggacggkctgttcccagtctcggaggcccaggtccacctggcactgggggaccagaggttgaaccccacagtcacctatggcaacgactccttctcggccaaggcct

SEQ ID NO: 4829 - DNA, 201 bp, Homo sapiens
cgagggcccagctcctgctgaaggccaccccagaggacaacgggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcct

SEQ ID NO: 4830 - DNA, 201 bp, Homo sapiens; identical to SEQ ID NO: 1186

SEQ ID NO: 4831 - DNA, 201 bp, Homo sapiens
tgctgagattacaggcatgagccaccgtgcccggcctttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctg

SEQ ID NO: 4832 - DNA, 201 bp, Homo sapiens
gaaagcagcaccgccccttggcccccaggtggctagcgctataaaggatcacgcgccccagtcgacgctgagctcctctgctactcagagttgcaacctcmgcctcgctatggctcccagcagcccccggcccgcgctgcccgcactcctggtcctgctcggggctctgttcccaggtgagtcggggtggggattgccgtc

SEQ ID NO: 4833 - DNA, 201 bp, Homo sapiens
ataaggacaggcattctgggcaggaggaacagcctgggcaaaagttgggagcagggagaaatcttgatggaggcaggaggaggaggaggtaggttggtgtrggccaggtgcagtggctcacacctgtaatcccagtgctttgggaggccaaagcaagaggattgtttgagcccaggagttcgagaccagcctgggcaacat

SEQ ID NO: 4834 - DNA, 201 bp, Homo sapiens; identical to SEQ ID NO: 1198

SEQ ID NO: 4835 - DNA, 201 bp, Homo sapiens
ttgattgatgggaggaagggtgaggttggcagagccttgaatgccaggtggaggagctgggactttccttcttggggtgatagggagtcatggagggtttstgagcaggccagggattagatagctgaaggctggatttactggaagccaatgagcagttggctatggtccttgtccacgcggcccatgttgtgggcagtg

SEQ ID NO: 4836 - DNA, 201 bp, Homo sapiens
aataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcag

SEQ ID NO: 4837 - DNA, 201 bp, Homo sapiens
aatgtgctattcaaactgccctgatgggcagtcaacagctaaaaccttcctcaccgtgtactgtgagtaactgagcccggagggctggactaggcagaccsggtgggagagacgtgcaggggcacctgcagaggcctgggggaatctttgccacttgctcgtagggtcaaggaggggctccttgcagggcaggtggggaca

SEQ ID NO: 4838 - DNA, 201 bp, Homo sapiens
agctgtgattttgaggtcaggagttcgagaccagcctgaccaacatagcaaagccccgtctctactaaaaatacaaaaattagccagccatggtggcgggygcctgtaatcccagatactctggaggctgaggcaggagaatcacttgaacccgggagacggaggctgcagtgggctgagatcgcaccactgcactccagc

SEQ ID NO: 4839 - DNA, 201 bp, Homo sapiens; identical to SEQ ID NO: 1249

SEQ ID NO: 4840 - DNA, 201 bp, Homo sapiens; identical to SEQ ID NO: 1215

SEQ ID NO: 4841 - DNA, 201 bp, Homo sapiens
agtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtaccctggcaccacttgtccagacc

SEQ ID NO: 4842 - DNA, 201 bp, Homo sapiens
ccatctcaaaaaaaaattataataactaaaataaataaataaagcatctatccttcagccatttgctaagcagctgctgtattccaggcactgtaccaggyaccgggagcccaccatgtacaaacagctgagtctaatggggtgggcagacgagcaatcacatacttactacagcataagcgataagacagagagggcttc

SEQ ID NO: 4843 - DNA, 201 bp, Homo sapiens; identical to SEQ ID NO: 1218

SEQ ID NO: 4844 - DNA, 201 bp, Homo sapiens
ggtggctcacgtctgtaatcctagcactttgggaggccaaagagggtggatcacctgaggtcatgagtttgagaccagcctggccaacatggccaaacccrtctccactaaaaatacaaaaattagccgggcgtggtggcgcatgcccataatcccagctacttgggaggctgaggcaggagaattgcttgaacctgggag

SEQ ID NO: 4845 - DNA, 201 bp, Homo sapiens
ccaggatgtacctgcagaaaggtaggcgctgatggcagggagctccctcagtcctgccctgggtggaggagggtgagagcaaggggctgggcctctggtakcgagtaggggcgtgtctggctgtggagcctggagccctgggaacagcttgtgctgcctccgtgcaggatttcccatcaaagaagatttcctggaacaatc

SEQ ID NO: 4846 - DNA, 201 bp, Homo sapiens
gacagtgcgagactccaactcaaaagaaaagaaaaaaaaagaaatcttaagccaaatcacaatatatttacacagctggcaaagtcacaagagggaggtgwgggagggtggggcgggcagcactcggcagtggctcacccacagaacccagctgtggtatgacagccagtgaccctgtctgtggtacatctggagaagctg

SEQ ID NO: 4847 - DNA, 201 bp, Homo sapiens
ctgaccattccttgaccgtctggaaggagctggagcagaagcccacccatcactacaagtcagcatccgaccccatccacacctttgacctgtacggcagygaggtggtcactggcaccgtgtccaacaagattggcgtctgctccctgcttgagccaccctcgcaggccaccacgaagctcagctctgagaacttccgcg

SEQ ID NO: 4848 - DNA, 201 bp, Homo sapiens
ggggcgttggcatggagggagggcttggctccgaggggacctcctatcctcatccctttctccacagttctcccctgtgagcgccatggagcccttgggcyggcaggtactggggagtgaggagcctgtgatggggggaaggtcccgggggtctcactggtggcttgggcagggtggggggcctgtgggaagggtcggtct

SEQ ID NO: 4849 - DNA, 201 bp, Homo sapiens
ggtccccttggcctgggtattgatccccgggccagacagctgtggctgagatggctgtatttgttagcttcccaaggcaagtgtgacacagagcacagccrcttctgcagggaggagccagaagccacttgggcagccctcctgggagggggctgtgggtgaggctggcccgggaacgcgtcctggcttccctgcagctca

SEQ ID NO: 4850 - DNA, 201 bp, Homo sapiens
gctggagtgcagtggcttgatcttggctcatggcaacctctgcctcccgggttcaagcaattctcctgcctcagcctcccgagttgctgcgattacaagckcccgtcaccacagaagcccagctcatttttgtatttttagtagagatgaggttttgccatgttggtcaggctggtcttgaactcctgacctcaggtgatc

SEQ ID NO: 4851 - DNA, 201 bp, Homo sapiens
gtatgcagaaggacccaggctcctgctgaggctctcctctcccgggacaggcggtggagggcagcgtcctggtcagctcctcctctgaccattccttgacygtctggaaggagctggagcagaagcccacccatcactacaagtcagcatccgaccccatccacacctttgacctgtacggcagcgaggtggtcactggca

SEQ ID NO: 4852 - DNA, 201 bp, Homo sapiens
ggtcaggctgggcagggcgggtaaggaggaagcgtctggctggcagtggagctgagtcagagctgtcctgtgtcctgctcttttccagggcttcgggagcrgggagagggttgaatatgagcccccagaccctctgtcctagaggaagttggggtggcccggggaatggggctctgctttgctgcccaagacctcgcattg

SEQ ID NO: 4853 - DNA, 201 bp, Homo sapiens; identical to SEQ ID NO: 1220

SEQ ID NO: 4854 - DNA, 201 bp, Homo sapiens; identical to SEQ ID NO: 1221

SEQ ID NO: 4855 - DNA, 201 bp, Homo sapiens
ctgtcacccctgagtgtggccctggcgctgtctcacctggcactaggtaccctggcaccacttgtccagaccaagagagctggaggccagtaggaactcastactccagtggttctccgcgggcggttcctccaccagggtcacgtggctgtttggtaaaaatgcagattcctaggccggggcggtggctcacgcctgtaa

SEQ ID NO: 4856 - DNA, 201 bp, Homo sapiens
acctgccccaacctcatcctgtcacccctgagtgtggccctggcgctgtctcacctggcactaggtaccctggcaccacttgtccagaccaagagagctggaggccagtaggaactcactactccagtggttctccgcgggcggttcctccaccagggtcacgtggctgtttggtaaaaatgcagattcctaggccggggc

SEQ ID NO: 4857 - DNA, 201 bp, Homo sapiens
gggacaaggccctgctgtcctcaggcacaggggctgtgacaaggccttcaacacagaacctggagctgaccccttgacctccctgacccctgatctgtccytgcaggagcctggtggccagactgccctgaagagtcccccaggagtctgcagcagagaccccaccccagagcagacccacaggctggcccgggccatgat

SEQ ID NO: 4858 - DNA, 201 bp, Homo sapiens; identical to SEQ ID NO: 1252

SEQ ID NO: 4859 - DNA, 201 bp, Homo sapiens
ggaattccagacgctgggaagcgctgtggagggaaagctgaaaaagaaggtgattttggccgggagcggtggctcacgcctgtaatcccagcactttgggwggcccaggcaggtggatcataaggtcaggagtttgagaccagcctggccaagatttgaaaccccgtttctactaaaaatacaaaaattagccaggcgtgg

SEQ ID NO: 4860 - DNA, 201 bp, Homo sapiens
ctacgggaaagagaccttagatcaattggatgccagctagcattccctggggtcttggcctccaccgctgtctcatccttgaatggattctgggtgggacrggcaacgggctgggggtgcagagcccaagctggtccccatcgacgtgacccctgccctctgccccaagctggtccccgtcgacgtgacccctgccctctg

SEQ ID NO: 4861 - DNA, 201 bp, Homo sapiens
ctaaaaaaaaaaaaagatccaggaggaggttcctaggagaattgcaggggttggggaaaacacaagcccagatttcaaaaatgctacgggaaagagacctyagatcaattggatgccagctagcattccctggggtcttggcctccaccgctgtctcatccttgaatggattctgggtgggacaggcaacgggctgggggt

SEQ ID NO: 4862 - DNA, 201 bp, Homo sapiens
gaagcagaaagatggccagtgtgaccagagtgtgacaaagtcagagaaaaccaggaagatggagctggagacacaggcggggccagatcacgagggtcctygcagaccagagcaagggtttggattttattccaagtatgaagggaagctgctgaagtgtgttttcctttacaatttgtagttgaaatataatatgcaaag

SEQ ID NO: 4863 - DNA, 201 bp, Homo sapiens
ctggtgattcttatgcaagagtttgctagctacactctttcccactgtgctggagggtctcactgtgggaaacggaagcccagagagggaaggtaacttgyggggggtgaggtcacccagcctgtcagccacaggggtgagagccacgcagaacagatccgtggctgtggaaggatggcgtgtggtcccgtggacgtcctc

SEQ ID NO: 4864 - DNA, 201 bp, Homo sapiens
ctccgtctcaaaaaataaacaacaaaaaatcccaaaaagacggtcttattttggtcctcaccatgcatgtgagaagagtgagggacttgtgccaccgtttkacaaggtaaggccaagcctggtggagttacgggaaatgccgaggtcctttggcaagaggtagcctggattcagacacagatctgattcacagcgcagggc

SEQ ID NO: 4865 - DNA, 201 bp, Homo sapiens
acccccgtctctgctaaaaatacaaaaaaattagctgggcgtagtggcgggcacctgtagtcccagctactcgggaggctgacgcaggagaatggcgtgarcccgggaggcggtggagcttgcagtgagcggaggtcgtgccactgcactccagcctgggcgacagagcgagactccgtctaaaaaaaaaaaaagatccag

SEQ ID NO: 4866 - DNA, 201 bp, Homo sapiens
gagggttgaatatgagcccccagaccctctgtcctagaggaagttggggtggcccggggaatggggctctgctttgctgcccaagacctcgcattgcaaggagagtctgggtagagagcctgggatggcatgtgagcctcgctggcttccctggaaggggaaggaggagaagctggggtgtcacactgttaaagaaatgct

SEQ ID NO: 4867 - DNA, 201 bp, Homo sapiens
cctggctaacacggtgaaacccccgtctctgctaaaaatacaaaaaaattagctgggcgtagtggcgggcacctgtagtcccagctactcgggaggctgasgcaggagaatggcgtgaacccgggaggcggtggagcttgcagtgagcggaggtcgtgccactgcactccagcctgggcgacagagcgagactccgtctaa

SEQ ID NO: 4868 - DNA, 201 bp, Homo sapiens
tcgcccagactggagtgcagtggtgcaatctcggttcactgcaatctctacctcccgggttcaagggattctcctgcctcagcctcccgagtagcttggamtacaggcgcccgccaccatgcccagctaatttttgtatttttagtagagacggggtttcaccatattggccaggatggtctcaatctcctgacctcgtga

SEQ ID NO: 4869 - DNA, 201 bp, Homo sapiens
actacaggcatgcaccaccacgcctggctaattttgttcgtttgtttgtttgtttttgagacggagtttctctctatcgcccagactggagtgcagtggtrcaatctcggttcactgcaatctctacctcccgggttcaagggattctcctgcctcagcctcccgagtagcttggaatacaggcgcccgccaccatgccca

SEQ ID NO: 4870 - DNA, 201 bp, Homo sapiens
cctgagtgtggccctggcgctgtctcacctggcactaggtaccctggcaccacttgtccagaccaagagagctggaggccagtaggaactcactactccartggttctccgcgggcggttcctccaccagggtcacgtggctgtttggtaaaaatgcagattcctaggccggggcggtggctcacgcctgtaatcccagca

SEQ ID NO: 4871 - DNA, 201 bp, Homo sapiens
actgtgctggagggtctcactgtgggaaacggaagcccagagagggaaggtaacttgtggggggtgaggtcacccagcctgtcagccacaggggtgagagycacgcagaacagatccgtggctgtggaaggatggcgtgtggtcccgtggacgtcctcgtcacgggtatccaggagggactggagtgggcagtgggggtga

SEQ ID NO: 4872 - DNA, 201 bp, Homo sapiens
gctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggtcggagtcggggccctggccaagggctcttgtgtgggatgggggtg

SEQ ID NO: 4873 - DNA, 201 bp, Homo sapiens
ggtggatcacgaggtcaggagttcaagaccagcctggccaacatggtgaaactctctctactaaaaatacaaaaaatttagctgtgcgtggtggtgcgcasctgtaattccagctactcaggaggctgaggcagagaactgtttgaacctgggagttggaggttacagtgagccgagatggcgccactgcactccagcctg

SEQ ID NO: 4874 - DNA, 201 bp, Homo sapiens
cagtggttctccgcgggcggttcctccaccagggtcacgtggctgtttggtaaaaatgcagattcctaggccggggcggtggctcacgcctgtaatcccarcactttgggaggctgaggcgggtggatcacgaggtcaggagttcaagaccagcctggccaacatggtgaaactctctctactaaaaatacaaaaaattta

SEQ ID NO: 4875 - DNA, 201 bp, Homo sapiens
aggacttggcgttatctgtgatcgcgtgggtaggattccctggcgggcgtggggatgtgagatgggaacagagctttctgtccctgccacaggaacatggygctgctctgggggctcctggtgctcagctggtcctgcctgcaaggcccctgctccgtggtgaggctgggctgaagtcaaggtggggtggggtggaggggg

SEQ ID NO: 4876 - DNA, 201 bp, Homo sapiens
ggcccaggcgggcagattgcctgaggtcaggagttcgagaccactctggccaacatggtgaaaccccgtctctactaaaaatacaaaaaattagccgggcktgatgacgtgtgcctgtaatcccagctactctggaggctgaggcaggggaattgtttgaaccagggaggtggaggttgcagtgagccgagatcgtgccgc

SEQ ID NO: 4877 - DNA, 201 bp, Homo sapiens; identical to SEQ ID NO: 1256

SEQ ID NO: 4878 - DNA, 201 bp, Homo sapiens; identical to SEQ ID NO: 1257

SEQ ID NO: 4879 - DNA, 201 bp, Homo sapiens
gccccatggggatcagctggggcttcagaggtccacccttctttagagcgagctactccccagacttcactaggcagcctgtctgacctcatctatgcctyggccattgtcgtcaatgtggaccactcctagtctttgtccagaacttgcaaggcccctcctctgactcctgtggcccaccctgcccctcctgggattgaa

SEQ ID NO: 4880 - DNA, 201 bp, Homo sapiens
catagctacagtggccgggagcgggtctacttcttcaagggtactcagggggtggtgggagactgagcaggcagtggagcagtcttggattcctttcacayttcactggggacaggcctcagcatgtgcccacccctgacccccacctcatgctgggagatcctaacttcaacagcctctgggatctccagtcttgccctg

SEQ ID NO: 4881 - DNA, 201 bp, Homo sapiens; identical to SEQ ID NO: 1259

SEQ ID NO: 4882 - DNA, 201 bp, Homo sapiens
ccagagtgtcttcttcttctctggaggtaggagccgctgccacccctgaagctggtctagcttgggttttccttgctgtccctggtgcacaagggctgaaygcagcctgcaagtagtgaccacagaaagccaggccagaagtccttagctgcatcatggatgttcactttcccttctgggagagaccctagacttctcaag

SEQ ID NO: 4883 - DNA, 201 bp, Homo sapiens; identical to SEQ ID NO: 1260

SEQ ID NO: 4884 - DNA, 201 bp, Homo sapiens
actcaaggcctgagacccttcatccagggagacctcagcccccagcagaggaggagctgtgcagtgggaagcccttcgacgccttcaccgacctcaagaayggttccctctttgccttccgaggtgaatccagggcaggtactggggatgcgggtctgccccaggagcgtccctgctctcacaccatctcctccactctag

SEQ ID NO: 4885 - DNA, 201 bp, Homo sapiens
cccagccctcctaatgcccaccaccccgctcctcagggaaacagtactgggagtaccagttccagcaccagcccagtcaggaggagtgtgaaggcagctcyctgtcggctgtgtttgaacactttgccatgatgcagcgggacagctgggaggacatcttcgagcttctcttctggggcagaacctctggtatggagagag

SEQ ID NO: 4886 - DNA, 201 bp, Homo sapiens
aagcccttcgacgccttcaccgacctcaagaacggttccctctttgccttccgaggtgaatccagggcaggtactggggatgcgggtctgccccaggagcrtccctgctctcacaccatctcctccactctagggcagtactgctatgaactggacgaaaaggcagtgaggcctgggtaccccaagctcatccgagatgtc

SEQ ID NO: 4887 - DNA, 201 bp, Homo sapiens
cagccccaagactccaggtcctgggcagtgaacctggacctgggaacggctgccttagggcaagggactctgcctctgtgcccagccagcggcctccataycccttttcactttccccacctcttagggtagtcagtactggcgctttgaggatggtgtcctggaccctgattacccccgaaatatctctgacggcttcga

SEQ ID NO: 4888 - DNA, 201 bp, Homo sapiens
cttcgacgccttcaccgacctcaagaacggttccctctttgccttccgaggtgaatccagggcaggtactggggatgcgggtctgccccaggagcgtcccygctctcacaccatctcctccactctagggcagtactgctatgaactggacgaaaaggcagtgaggcctgggtaccccaagctcatccgagatgtctgggg

SEQ ID NO: 4889 - DNA, 201 bp, Homo sapiens
tcagtactggctgggctgcccagctcctggccatctgtaggagtcagagcccacatggccgggccctctgtagctccctcctcccatctccttcccccagyccaataaaggtcccttagccccgagtttaaaattattgttctgactggggtagacacatccctgtctgggtaaaggagaggaagctggactgtcagaatg

SEQ ID NO: 4890 - DNA, 201 bp, Homo sapiens
ctggaccctgattacccccgaaatatctctgacggcttcgatggcatcccggacaacgtggatgcagccttggccctccctgcccatagctacagtggccrggagcgggtctacttcttcaagggtactcagggggtggtgggagactgagcaggcagtggagcagtcttggattcctttcacacttcactggggacaggc

SEQ ID NO: 4891 - DNA, 201 bp, Homo sapiens
ttcgatggcatcccggacaacgtggatgcagccttggccctccctgcccatagctacagtggccgggagcgggtctacttcttcaagggtactcagggggyggtgggagactgagcaggcagtggagcagtcttggattcctttcacacttcactggggacaggcctcagcatgtgcccacccctgacccccacctcatgc

SEQ ID NO: 4892 - DNA, 201 bp, Homo sapiens
cccacccctgacccccacctcatgctgggagatcctaacttcaacagcctctgggatctccagtcttgccctggcccagccctcctaatgcccaccacccygctcctcagggaaacagtactgggagtaccagttccagcaccagcccagtcaggaggagtgtgaaggcagctccctgtcggctgtgtttgaacactttgc

SEQ ID NO: 4893 - DNA, 201 bp, Homo sapiens
tgcagggagtcccagcttgacccccaccatggcctgcagacggtggcagcgggttgggttcccaccggagaaagcggaccaccttcagcaaagggcagctrctggagctggagagggcgtttgcagcatggccctaccccaacatcagcacccatgagcacctggcctgggtcacttgccttcctgaggccaaggtacagg

SEQ ID NO: 4894 - DNA, 201 bp, Homo sapiens; identical to SEQ ID NO: 1255

SEQ ID NO: 4895 - DNA, 201 bp, Homo sapiens
cagccacgccccggaggagcagcggtccccgggccgacgccccgcctctgggtcccgcggggctcctccagcctcctgcagccacgccccggaggagcagyggtccccgggccgacgccccgcctctgggtcccgcggggctcctccagcctcctgcgcagccccacccccaagccgtccccagccacgcccacgcccctg

SEQ ID NO: 4896 - DNA, 201 bp, Homo sapiens
cccccggcgacactttcgcgggcccgggccacccgcagcccaccatgggcccgtgccaccgcccccatctggcccaggcaccgccagccgctcggcgcccsgccgtgggcccgacatggcgaagaagcgacacagcttgtaggcggagagaagcagcgtcaggaccatgggcgcggggccgcgggggacatccccggcctg

SEQ ID NO: 4897 - DNA, 201 bp, Homo sapiens
gccagaagtccttagctgcatcatggatgttcactttcccttctgggagagaccctagacttctcaagggaagagtgggcagggccaggctgggcctcacrcatcctctgctttcctctcttccagacaagtactaccgagtcaatcttcgcacacggcgagtggacactgtggaccctccctacccacgctccatcgctc

SEQ ID NO: 4898 - DNA, 201 bp, Homo sapiens
ggagagaccctagacttctcaagggaagagtgggcagggccaggctgggcctcacgcatcctctgctttcctctcttccagacaagtactaccgagtcaaycttcgcacacggcgagtggacactgtggaccctccctacccacgctccatcgctcagtactggctgggctgcccagctcctggccatctgtaggagtcag

SEQ ID NO: 4899 - DNA, 201 bp, Homo sapiens
gcagctaagcagacacttgaactcctctgatgatgacaaagttaccaggccagcctccgtgggtgaggcttgctttgccccttggagttgactagggtctyggaggagagagaaggggcaagagttggtggggttctggctcagcttttttgtccatcctgatctgaaatcctagtagctctgactcctgagcacttgggg

SEQ ID NO: 4900 - DNA, 201 bp, Homo sapiens; identical to SEQ ID NO: 1263

SEQ ID NO: 4901 - DNA, 201 bp, Homo sapiens
acttcttgtggaaaagtggcccaggagcccaggagtttgaagctgcagtgagctattattgtaccactgcactccaacctggggaatagagtgagactctrtctctaaaaacagaacaaaataaaaaagggggggaatttttgtctgggcatggtggctcatgcctgtaattccagcactttgggaagccaaggtgggagg

SEQ ID NO: 4902 - DNA, 201 bp, Homo sapiens
aaagttacacatttggtatgattacaactacattaaaaattcgtgtgtgtgtgtgtgtttatacacatatatacaaacgtgtatatttatatacacatatrtacaaacgtgtatatttatatacacatatgtacaaacgtgtatatttatatacacatatgtacaaacatgtatatacacatatgtacaaacgtgtatatt

SEQ ID NO: 4903 - DNA, 201 bp, Homo sapiens
gcaaagaaaaataggcaaaatgtaaaataaattttgcctgttttcccatgcacacacattgaaaggaaacacaacaaaaatttcaaagcatgttggagaargccctaaggcatatgatgtctggtatttgaagaagtgcaggaaagagcaaaagagaggaatgggcaggggccatatctctcctcataggcaggtttagca

SEQ ID NO: 4904 - DNA, 201 bp, Homo sapiens
ttattttaaattttaggtacattacaaatggcaacgtatggtagtctcttatttttcttccttttttaggtctgcaatattttgatagcattgtattcaaratttattgattcattttatgtgctttagcactttgctaagtattattgtggatattaatggaatataagacattatcttggcccacatggaggctaaaat

SEQ ID NO: 4905 - DNA, 201 bp, Homo sapiens
aaaccatagattttggctaaaatctataaaaccatagattttggctaaaatctataaaaccatagattttggctaaaatctataaaaccatagattttggmtaaaatctataaaaccatagattttggataaaatctataaaaccatagattttggataaaatctataaaaccatagattttggataaaatctataaaacc

SEQ ID NO: 4906 - DNA, 201 bp, Homo sapiens
tccatcttgagaaacaaactctgaatgcattaatcagtcacaccccattctcccgctcatcagcccctggcaaccaccattctacctttgtttctatgaayttgatgactctgggtatctcatataaatgaaatcatacagtatttgtctttcttgcaactgacttatttcacttggtgtaatatcgtcaaggttcatgta

SEQ ID NO: 4907 - DNA, 201 bp, Homo sapiens
gatatgtgataaataatttggatttcagaaaccatagattttggctaaaatctataaaaccatagattttggataaaatctataaaaccatagattttggmtaaaatctataaaaccatagattttggctaaaatctataaaaccatagattttggctaaaatctataaaaccatagattttggctaaaatctataaaacc

SEQ ID NO: 4908 - DNA, 201 bp, Homo sapiens
tatttgtcccaattacttattatacttgaactttttctttttgcttagatgtactttattacatatttgatttcagtattatgtcacattattaaatagtrcttattgttaccaccacaaatgaaagtaaagttgtgagttatataataattaaaaatatatgtttcatctacttgtgatcatcaaaatatgtgaaaatac

SEQ ID NO: 4909 - DNA, 201 bp, Homo sapiens
tctgtcctcacaatagtttgctcagaatgatggtttccagcttcatccatgtccctgcaaagtacacgaactcatccttttgtatggctgcatagtattcyatggtgtatatgtgccacattttcatatgtctgtctaaagtagtcttcccagacctgtaagtcccctaattgaaattataccttttggcaccttttgtaa

SEQ ID NO: 4910 - DNA, 201 bp, Homo sapiens
atgtatacatgtgccatgttggtgtgctgcacccattagctcatcatttacattaggtatatctcctaatgctatcccttccccctccccccaccccatgrcaggcctcagtgtgtgatgtttcctaccctgtgtccaagtgttctcattgttcaattcccacctatgagtgagaacatgcggtgtttggttttctgtcct

SEQ ID NO: 4911 - DNA, 201 bp, Homo sapiens
gcctatttttaggagatgagagtaaactttcgaagacatttcatatgattgctattaagacactgtaacatagattgtttattacaaaaatgagaaaattytcacccgtttagtcagtgttgcttgtcattagaggaaattagttgattagggcctctagcagacaaacttgctttctcagcaataaaatgttattagagt

SEQ ID NO: 4912 - DNA, 201 bp, Homo sapiens
ttttatgatagtttaaaagattttgtaaaaagattattttttccaaattttcttttcaggtgctagtggagaccacgtttatacatatagttatgatgctraaagagaggattttggtgctcaagatgcaacaaaactggatacgtgggtttttgataatgttaaggtttgtgctattgagtggttaatatacaaaaagca

SEQ ID NO: 4913 - DNA, 201 bp, Homo sapiens
gattctaaaagtatttatgctcagtggaagaattcagatggaagagagtacatgatgcagaaatagatttttataaaattcaaaaatgcaaacaaatctayagtggtagaaaatacattagtgggctgggcatggtacacctataattccagcacttgggaggccaaggtgggcagatcacttgaagccaggagttccaag

SEQ ID NO: 4914 - DNA, 201 bp, Homo sapiens
cacatatgacagattctttttgggcgtcaatgttgttattggttttgtgggatggatatcttatgcctctttgttgatcatcaagtctcattccaaccttwtaaaaggtgttagtaaagaagtgaaggtacgtttagaaaatgtgaggattcagatgatggtataaaatcactagtactgaatccagtgtaatgagtttat

SEQ ID NO: 4915 - DNA, 201 bp, Homo sapiens
ggagtttggtacgttaataaaaaccagagaaatagaaccaggctatatatatatataatatatatacatatttatatatatatatgtattatatatatatwttttattatgctttaagttctagggtacatgtgcacaatgtgcaggtttgttacatatgtacacatgtgccatgtagtataagaaattggcttatgtgat

SEQ ID NO: 4916 - DNA, 201 bp, Homo sapiens
aactttgtagttaaatctaatacggttatatttacacacagagattagtctatatttttcacatgtgctgtggttctacctgtaagtgcttcctcacaggytgtacttaaaatagagtgtattgttaacattgtagaaaacattagaagtaaggctctttggtgagtttcaaacacttttaataaaaccactagaagggag

SEQ ID NO: 4917 - DNA, 201 bp, Homo sapiens
ggaacccttagttttgctcttaaaggttttcaacggattgaatgaggactacccagattatctaggataatctcctgtacttaaagtccctgacctttacmccatgcagactatcactagtgaattagattgatgaattctctgttttggcaggtgattgggaatagtgcatatgactgaatgaagtttctattgggtggg

SEQ ID NO: 4918 - DNA, 201 bp, Homo sapiens
ctgaacaagttacttgcaaacaaactttaaggccatagtcacttttaagttgagaattgcttaattgcagcaattccaggttatctaggtttttcctctcwaatatgctcctcaaataatagatttttttccttgtcttaatgcagctctttgattaatcatctagtagtataaccattgaaagaaagtaataggttttct

SEQ ID NO: 4919 - DNA, 201 bp, Homo sapiens
aagctgttacgtgattcttcatagcagctttatttgaaatagccaaaaacttttagaaacaacacaagtgtctgttaacatgagagtgaataaacaaattrtgctatatctgtgcaatggaataatgctcaataataaaaaggaacaaacatatatgattctaaaagtatttatgctcagtggaagaattcagatggaaga

SEQ ID NO: 4920 - DNA, 201 bp, Homo sapiens
aaagcagtgactcacgcctgtcatctcagcactttgggagtccaaggcaggaggattgcttgagcccaggagtttcaaaaaaaaaataataaaaaaataakaagaagaaatgaaagcacacgcccatacataagctgttacgtgattcttcatagcagctttatttgaaatagccaaaaacttttagaaacaacacaagtg

SEQ ID NO: 4921 - DNA, 201 bp, Homo sapiens
acaatcataacatcaaagatcactgatcgtagatcaacataactgacaatagtaatgaaaaagtttgaaataattgcaagaattacaaaatatgacacagrcatgaagtgagcacatattgttggaaaaatagcaccaatatacttgctcaatgctgggttgcttcaaactgtcaccttgcaaaaataaatctgcgaagag

SEQ ID NO: 4922 - DNA, 201 bp, Homo sapiens
cagagtttatttgcatgatttggatcaccaataagaagtcccaatcttaattaccaatttggcaggaaaatatatctttgtctcttctattgctttcttcagcataatgtaaagtcaactatttacaggttgattttaaaaatatgagttgggttgcttcacaatctagttatttttagtattgctaatattttgtgttcg

SEQ ID NO: 4923 - DNA, 201 bp, Homo sapiens
agtgctaattatatggcttaatagtttatctgataatcttgtgtgcaggctccaagtactatcttacagtttttctttcctcttcttctttttttttttttaagtgggtcttgctatgttcccaggctagccttgaattcctaggctcaagcaatcctctcgcctcaccctcctaagtagctgggactaccagctctgtct

SEQ ID NO: 4924 - DNA, 201 bp, Homo sapiens
taaaatacttctagattaaaaaaaaataggtaaataaagcccttgaaacaaatccgttagagcttattttagtttttgaataatctataaatggaaaattmtgtagtgttttagctttgtgcaaagtttgtattgttatactatgtatgacctaactttaaaattcaatcagtctttttatttgaaacagatttcaagtta

SEQ ID NO: 4925 - DNA, 201 bp, Homo sapiens
aaatacttctagattaaaaaaaaataggtaaataaagcccttgaaacaaatccgttagagcttattttagtttttgaataatctataaatggaaaattatstagtgttttagctttgtgcaaagtttgtattgttatactatgtatgacctaactttaaaattcaatcagtctttttatttgaaacagatttcaagttatt

SEQ ID NO: 4926 - DNA, 201 bp, Homo sapiens
gtctttcactaccttctctttttttaacctatttcatctttgtctttaggtgctgagcacagtgctctccatgtatgttgtgtatagcactcagagtagtytactcaggaagcaaggactgcctctcatgaatcaaattattagctgggcaacattaggtaagaggccactcaaaccaggtgaggtaatttgacatcaact

SEQ ID NO: 4927 - DNA, 201 bp, Homo sapiens
tatctatgatacacactagatccatgtttttcttttgaaaaaatcactagcagcccactacagatatggtccaccttgctcatattagggaagaggaaaayaacttactaggaactgagtgaggatgacctctcaggcctcattattctcggtacacagcctcttcaatctggctgttttaaaatgcattcacaaggagtt

SEQ ID NO: 4928 - DNA, 201 bp, Homo sapiens
cttttgatgatttttgttgtttgggtcatgggggcccacccctcatgaatggctgtactaacttacattcccaccaacaatgtacaaaggttcccccttcyccacatcattgccagcatctgctattttttatctttttgataatagcaattctaactggggtgagatgatatctcattgtggttttgatttgcatttctt

SEQ ID NO: 4929 - DNA, 201 bp, Homo sapiens
aggtggtgccacctactgagattgtgaacactaaggatttagtaggtagtagacaaggctcatgggaaatgttatgaatttggttttaaacctacttagttgagtgtctttgaaacgtccatgtagatttataaaggttcgagttacatatgtggatttggagctataatttgttgaggcttttgcatattaggtaataac

SEQ ID NO: 4930 - DNA, 201 bp, Homo sapiens
atctcatgattttcctcacctgtgttctctctgcctgtaacatctttttctccttttgcagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcacca

SEQ ID NO: 4931 - DNA, 201 bp, Homo sapiens
catgtgtaactcaaggaactgtttatttttaaagaaaagggtagaatgtgttcttacataaaagagcctagtcatattgataggaggactgacattacctktaaggtttcagtaattcacttagactttcacatcaaaatgggccagttatgtggtaattgaaatgctatataagttgtactgatatgtccatctctgaag

SEQ ID NO: 4932 - DNA, 201 bp, Homo sapiens
cagtgttttgtgtttcctgacatccagtgtattacttgaacattttatagaattatttttttacttttctgtggtgttattaatgtatctctttgtatggytttttaaatggttgctgtaggtattatatatacatagctaatcccagtctactggtgatgtcattttaccagtttaagtaatatatggaaaccttacctc

SEQ ID NO: 4933 - DNA, 201 bp, Homo sapiens
gaagaattttgtctcattgatttttatttttattgcattccttatattgattttaaattatgctttgatttgtccattcttctttgaatatagtattttttaatcttacatatctcacagttcagatattcatttgattcagagaaccttcagaatattttcccaaaacttttaaagatttttatttaagattgaaatttt

SEQ ID NO: 4934 - DNA, 201 bp, Homo sapiens
acttatatttccactttgatactttttgatagaagtagcaggaagatatcttctttctactctgagaatttattaaaaaatcttcaatgaatgggattatmgatcttttaatttgtgagggatcttaatctaattacaaaagtagttttacttattttccttctgggctcagttgtttggtgattattgtaggccaccttt

SEQ ID NO: 4935 - DNA, 201 bp, Homo sapiens
gataagtatgtatttattatagattattaaaaatacagtcagtcttgattttcttccttcagctacatagggaattacaatgtgcttctacaaagaatgcwcttatatttccactttgatactttttgatagaagtagcaggaagatatcttctttctactctgagaatttattaaaaaatcttcaatgaatgggattatc

SEQ ID NO: 4936 - DNA, 201 bp, Homo sapiens
ccttccttcatccccatggagaaagtgctacaggcattttattccaagtagaaaaccagaagacacctctaaagagacaaaaaaacaaacaaacaaacaamgacctgggaggaatttcattgctatgatatatgtgcctccactttagtaaggctgttctccattctagcatgtgtagcctcctcctaacaaaggacagag

SEQ ID NO: 4937 - DNA, 201 bp, Homo sapiens
tgggaccaccatgtatatgcagtccattgttgactaaaacatcattatgtggtgcatgactacactcacgcagaagttcttaatagtgcagtaaaaaaaaattaaaacttagtatcttagtatagaaggtgcccatatgattttgaggtaagcgcagcaattagcaattattttaagcccctggaaatgagacatctttcc

SEQ ID NO: 4938 - DNA, 201 bp, Homo sapiens
ctacttgggagactgaggcaggagaatcgcttgaacccaggaggcggaggttgcagtgagccaagattgtaccactgcactccagcctgggcgacggagcragactccatctcaaaaaagaaaaaaaaaatcaacaatgaaatatcattacacacttaccagaacagtttatcagaatagttaaaaacaaatagtggcatc

SEQ ID NO: 4939 - DNA, 201 bp, Homo sapiens
gtctttactcacatagttttatggttcactcaggtggagggagtgaaacatacaaagggcatgagttgaaaacatgcttggtgtatttggagaacagcaagaaaggtagccttaagcagagtgtgctagcagaagaattgtaggaaataaagttgaacaggttggcaggggcagaaaagaaggggccacagataggacttc

SEQ ID NO: 4940 - DNA, 201 bp, Homo sapiens
attgtatctttcagagtggagattggagaattggaagaggctagatgtcaatcaggtatccagttcgattttattacattcaaatttaattttatcttctrtaagaaggttagacaaaaactatgaaaaagagataatattaatattgacaaagtctttttcaaaacatttcagttactaaggggaattcttttagtgcaa

SEQ ID NO: 4941 - DNA, 201 bp, Homo sapiens
catcaaatatatttataatactgtactttcaaacctccagtccctctcacttcatttataactgcataaatgttgagtaggatataaacattctttctgtygtacttttcccttttgacttcatctttatttttctgaagtggcagtgttcacttctttgtgtatcttttatagaaaaaaaatggaataaaagtaacgatt

SEQ ID NO: 4942 - DNA, 201 bp, Homo sapiens
tgttgacctatcctctgagccattttgttgggtacctgttagcctttaccctgggaattgaagtattagtaagtaacttaccagattacaacatttgcaartttcttttatatatttgtaactagtattaaatgaccttatttttcattccttctttggaatgcattactaggttctcagttttttctaccgctatatgct

SEQ ID NO: 4943 - DNA, 201 bp, Homo sapiens
cacctgttgtattagatgtaatttttccttctttttttttccagcctttttctcattgttctcgtcatatcagacattatggctttggtaaggcattactrggtagtccatataaattagattaagagtcctgggttaatttaataaagagaaatatgaatgcattttggtacgtgaaatctttagatgttgagttgtaag

SEQ ID NO: 4944 - DNA, 201 bp, Homo sapiens
ctagttaggcaagtcctaaattcacaggtcaggctgtcaggaaaggcagactgaactcgccagcaggagctgaagctgcactcaacaggtagaatttctcctttagggaacccttagttttgctcttaaaggttttcaacggattgaatgaggactacccagattatctaggataatctcctgtacttaaagtccctgacc

SEQ ID NO: 4945 - DNA, 201 bp, Homo sapiens
ccttttcatgtttatcttaatattcagtttattgagaaaaaaatatgtttttatattgatatgttaacaagatttcatagctgatagttcttcattattcrttaatctgataatacagccaatatttaattgagtgtatggtacaatgctagatgctggcaagggtatccaatcttttggctaccctaagccacattggaa

SEQ ID NO: 4946 - DNA, 201 bp, Homo sapiens
ccttctttggaatgcattactaggttctcagttttttctaccgctatatgcttaccgctggacttactgcctttgcagcttggccatttctcactcggctrtggactcgagcaaaggtatgagtactcattttgacataggacagattagtaactactttgttttgacacatgtgtaactcaaggaactgtttatttttaa

SEQ ID NO: 4947 - DNA, 201 bp, Homo sapiens
aactataagctatttcttggaagacttcagagaacaaacagcaattcaggtttttttctttgatttttgttttgtttgctgttttgtaattttcactatcwttgttttttaattaaggggaaaaaagaaacatatacttggaatgaggaaaccctttaaacctattcttttttttatatatagactgctttctgattccaa

SEQ ID NO: 4948 - DNA, 201 bp, Homo sapiens
tggattatatgactttcataagtgtagtttggcatttgaaacttcgagtcaagaaaaccaaatttaactataagctatttcttggaagacttcagagaacmaacagcaattcaggtttttttctttgatttttgttttgtttgctgttttgtaattttcactatctttgttttttaattaaggggaaaaaagaaacatata

SEQ ID NO: 4949 - DNA, 201 bp, Homo sapiens
gcaaaaaaggaagctgaagctgaggaggattaagttacttattaaaggccactcagatagcatgtgagggactgagactttaatccagagcagtcgtgggycagagagtgccttttcatgtttatcttaatattcagtttattgagaaaaaaatatgtttttatattgatatgttaacaagatttcatagctgatagttct

SEQ ID NO: 4950 - DNA, 201 bp, Homo sapiens
attattaaatagtgcttattgttaccaccacaaatgaaagtaaagttgtgagttatataataattaaaaatatatgtttcatctacttgtgatcatcaaartatgtgaaaatacatatgaatgcattaagatttaccccaatttaattttgttctctctttcagctgttcttgaagactaattagttacactggatatgct

SEQ ID NO: 4951 - DNA, 201 bp, Homo sapiens
ccttgaaacaaatccgttagagcttattttagtttttgaataatctataaatggaaaattatgtagtgttttagctttgtgcaaagtttgtattgttatastatgtatgacctaactttaaaattcaatcagtctttttatttgaaacagatttcaagttattcaggaccttgttgtatcagtgttgacctatcctctgag

SEQ ID NO: 4952 - DNA, 201 bp, Homo sapiens
tgggtgcaggcttgctggttcttctgttatccctgtgtgttgtaacatctctcatgaaaagaaaagatagctttataaaggaagagctattggtacatctrttacaggtcagttacagattttcaatactatgttatactaatgatatactgaaatgtgtcttatggttatatttaattatgttcataaaatgccattacc

SEQ ID NO: 4953 - DNA, 201 bp, Homo sapiens
gctttccaggggttcagattcttcattagaatgtaattcatgttcttcttctctaaggtcattatgcttgttttattccctttaccataatgcctgacacrttttacttagtatatatttgtttaaataaagtaaactgattcttgcctaaaatccgattacctaatgttcagatttatgaataaaaatggttaaaggtgt

SEQ ID NO: 4954 - DNA, 201 bp, Homo sapiens
acaaatggaagtttaagaagtgttaaaaagatgttcagtttctcacatcctgttccctactgagttattttaaaacatgttgctatttccttaattttcaytcacattttttaaatggttttttttcccagtttattaaagaccattggcctttaattaaaaacaagcaagcaagcaagcaagcaagcaagaaagaaagac

SEQ ID NO: 4955 - DNA, 201 bp, Homo sapiens
ccactctgaaaagagttttacagtttcttatgaaactaaacatgctactgttgtatgacctagcaattgcactcttgatgtattttcctagagaaatgaawggtttacacaaaaaattagacacaaatgtttataaaagctttatttgtaagagccacaaactggaacaatagccacaagtagaaacaacccttgatgtcc

SEQ ID NO: 4956 - DNA, 201 bp, Homo sapiens
aggttgcaagtacattctgcagagaggaattgagcctacaaaggtcttatagcagtgggatacttgaataaaagaaggggccagtgatgtgagatgttacmaagtaaaggggagtgctatgagacaggtttagaaaagaaggcagaggctagtctataaaagaccttgttagtcacattaaggattttagtctagattagt

SEQ ID NO: 4957 - DNA, 201 bp, Homo sapiens
tgccaggatagaaagtatagagtgagaagaaaagacagctgaggaccaagttttgagtaactccaaaatttagtgatcagatagagactgttcaacattgrtcagaggtgtaggtgaaaaatgaaagcagtaatgttcatagaagccaagtgataacagcctattaaaaaggagaaggcagccgggcatggtggctcatgc

SEQ ID NO: 4958 - DNA, 201 bp, Homo sapiens
tatgtataaacatacacacactatataaacatacacacacatataattgtaatgtacaagtcaaataaaaggtcaataaccctaatcctatctgatcaaargatatgaataggcagttgaaaggaagagagacccaattggccaataaaaacatgaaaaaattttcatactcactagtaatcaggcaaatacatattcaaa

SEQ ID NO: 4959 - DNA, 201 bp, Homo sapiens
gtaagtattcttttaagcagatttagatcacatgtatagttcagtaatatagtaaataatggtatttctgtggaatgcttggtctactaatgttgctgtggtttatttaatcatttttctcaaaatctgatcttaatggcagctcattatatagacatagtcagtttttattgttaagaagttattccatttctgaataag

SEQ ID NO: 4960 - DNA, 201 bp, Homo sapiens
actatgtagaatgttgtatttcaaacatgttgctttttaagttaatacttcattagtttatccatatctgtaactatgcatagattaaagggaaaatgaamaacaaatagtaaaaccatcacttttccttgtgggcaatctgaatttgggcagttgataggaagatatattagttttctagggttgccataacaaactacc

SEQ ID NO: 4961 - DNA, 201 bp, Homo sapiens
acaagaaataatttaaaagaaaaaatgccacagaataagaagaaagcaaaaaagatctcttcagagatatcttagggggaagaatacggaattgggaaggrgatatataccttgccaatagaagcaaaaatatttgttacttttttatttgaaaattattatataaatttgataaacaaagaaattttaacaaaaaactgt

SEQ ID NO: 4962 - DNA, 201 bp, Homo sapiens
ctttagaggctggagtaagacaagaaataatttaaaagaaaaaatgccacagaataagaagaaagcaaaaaagatctcttcagagatatcttagggggaaraatacggaattgggaaggggatatataccttgccaatagaagcaaaaatatttgttacttttttatttgaaaattattatataaatttgataaacaaaga

SEQ ID NO: 4963 - DNA, 201 bp, Homo sapiens
catacattttagagaaaaggaatgggcattttttcatcaactgattagtgtgaatttttggtagagtcagaaacgtatttttaaactttaattagcttattgaatgaaattttattatacaaatatcttataactcttttggcagtgtatcctaaagccattaaatcaagacggtctctcataatcacttgtttagatttc

SEQ ID NO: 4964 - DNA, 201 bp, Homo sapiens
gttactgattttgaatgtaatgaatccacgttgaataaatttgatttctccaaattaatttaatttgttcctctgtttctttacaaatagagactacaagsacaatattaaaaaagttgatgatggagttaaagaaatcgtgtctatgtttaaccacttctatggaaatgatgggaaaacaacatttatctttacctctga

SEQ ID NO: 4965 - DNA, 201 bp, Homo sapiens
gtgttctgctaattacttcaatttaatcagaatttctttgttagccagagtattacatttcttcagaatgatggattatatgactttcataagtgtagttyggcatttgaaacttcgagtcaagaaaaccaaatttaactataagctatttcttggaagacttcagagaacaaacagcaattcaggtttttttctttgatt

SEQ ID NO: 4966 - DNA, 201 bp, Homo sapiens
ttaaacctattcttttttttatatatagactgctttctgattccaaacagttcaacattttaagaaaagcaagatcttatataaaacacagaaagtttgaygaagtggtaagtataccggccttatagacataaatagctgattatcattttggggatggagaggagaaaaatagagcaaagtaggcaggccagggagctt

SEQ ID NO: 4967 - DNA, 201 bp, Homo sapiens
aaaaagggtttattaaaatatatttgttaatcattcccctccttttaagccatctttgaaaactatttcaggttatttagcttcattaaaaggagaaaaaattattttaacaatctagagtactctgattttaaaatattaaagatgaaatctaaaagcatttcagaagttactgattttgaatgtaatgaatccacgttg

SEQ ID NO: 4968 - DNA, 201 bp, Homo sapiens
ttacatttttttattaacttgaaggaaagaattttccactgagtttgcaatttttcactgagtgataggattagtttacttatacagtttgccattttatrtacattagtgtaaactccaaattgaaatcctcttctattgctgttgttaaataatgagccaggtgctagataactttgaatggctggaagagggatgagg

SEQ ID NO: 4969 - DNA, 201 bp, Homo sapiens
aagaagacaaaggcacagccagttaataagttatgttaaaccttagtttatctcattctcagtatttcatcattggggatctaacccccataggttaaacrggatgcttgctctgagaaacttctcaaaggcaggtataagaaaccttagatctgtcttcatcaggctgatggcactgaacaaatctacataaatttccca

SEQ ID NO: 4970 - DNA, 201 bp, Homo sapiens
ttataaagttttctttggaattataacaacagagctaatattttaaacaactactgtaatgtttattaagttctcaattatatgagatttccaatatagtsgtttaaatcatatgtgctgtatccagatggcacattaatataagtaaaatatatcctgtacatattacataatcttcatttactgaagcagagaaaaaaa

SEQ ID NO: 4971 - DNA, 201 bp, Homo sapiens
cagtttcttatgaaactaaacatgctactgttgtatgacctagcaattgcactcttgatgtattttcctagagaaatgaaaggtttacacaaaaaattagrcacaaatgtttataaaagctttatttgtaagagccacaaactggaacaatagccacaagtagaaacaacccttgatgtcctttggtgcttgaatggttaa

SEQ ID NO: 4972 - DNA, 201 bp, Homo sapiens
ttaagtaaaccattgtatatccatatgatggagtactattcagccataaaagtaaatgacccattgatacagcaccttggatgattcttgagaaaattatkctaagtgagaaaagccaatcccagaaggttacaaaaggtaacaaagtgttatataaattgttcaacttgttatgtatgtgattctactcataaaacactc

SEQ ID NO: 4973 - DNA, 201 bp, Homo sapiens
aatcttgatgaaaaaatatataccccagaataataagcaaatgaactagtgctaattatatggcttaatagtttatctgataatcttgtgtgcaggctccmagtactatcttacagtttttctttcctcttcttctttttttttttttaagtgggtcttgctatgttcccaggctagccttgaattcctaggctcaagcaa

SEQ ID NO: 4974 - DNA, 201 bp, Homo sapiens
ttaatttgattaggggagttgttttcagatcctcttaaaagcttttttgagggggaggggattgaattgcatgacagtttaaaaatggtctcattgtctcrtagccatgatttttataggaactaagtaattgtataggacattcatttttctgttcagctagttgctatgtatgtttttaaaaatattgtgcttacctaa

SEQ ID NO: 4975 - DNA, 201 bp, Homo sapiens
tgaactcaaagtttgactcaattgcctttgctttataatatgccatttcttcatataggcaataaacatttactaaggagctattaatgggtcagtcacargtggaagaatgttgtgaatatagaagtgaatgggagtgtgtctaaaagatcatataatttggtatgtaaaactgaaaaagtaagtaattacagcagtgaa

SEQ ID NO: 4976 - DNA, 201 bp, Homo sapiens
tgtccattaccttaaatagttatcttttctgtacaccaggatctttttaattattctgttccagctattttgaaatgtataatatattaatgttaaccatrgtcatcctactgctctattgaacaccagctcttatttcttctatcaaactgtgttatttatacccattaatccacctctcttcattgccttctcccctct

SEQ ID NO: 4977 - DNA, 201 bp, Homo sapiens
ctttataatatgccatttcttcatataggcaataaacatttactaaggagctattaatgggtcagtcacaagtggaagaatgttgtgaatatagaagtgamtgggagtgtgtctaaaagatcatataatttggtatgtaaaactgaaaaagtaagtaattacagcagtgaactaggagctaccatggaagtgtttctaagg

SEQ ID NO: 4978 - DNA, 201 bp, Homo sapiens
tgtgaacactaaggatttagtaggtagtagacaaggctcatgggaaatgttatgaatttggttttaaacctacttagttgagtgtctttgaaacgtccatktagatttataaaggttcgagttacatatgtggatttggagctataatttgttgaggcttttgcatattaggtaataactgaagccacagatatgatgaaa

SEQ ID NO: 4979 - DNA, 201 bp, Homo sapiens
tacagtatttttttttccttcttagttatacttgagatattggcacatcatacagttagatagtattttggattcaattaagtggtatatagcactatcgsttaacagctatataatcttgagcaatttatataacctctctgagcttcaatttccttttcataaaatgtgataatattagtttctgtctcatagatttat

SEQ ID NO: 4980 - DNA, 201 bp, Homo sapiens
gccaggtgttactgaatttaattcatctcttgctttgcttaccttaatacatctactttgtgagaaaaataatagaacatctttcagttatagttttaaawagatttttcatttaactatttcaattatttatttgtccatatgccttatctttattgcttttaagtctgttttgttttataaggatagcctgagctgtct

SEQ ID NO: 4981 - DNA, 201 bp, Homo sapiens
aagtattggccactcctaaaaatcaaatgatttattcttttttaaatcttaacatcagatcttgtgtctgattgtatctttcagagtggagattggagaaytggaagaggctagatgtcaatcaggtatccagttcgattttattacattcaaatttaattttatcttctataagaaggttagacaaaaactatgaaaaag

SEQ ID NO: 4982 - DNA, 201 bp, Homo sapiens
ggcttaggaataccctcccggctatcgcttcagtgggtagaggggaccactgcccgagagctttaatggagctgggtcctgccttcgcgctgaggagcccycgttttcgagatcaggcctgaccgggataagctccaggtaaagttcagggaccagtgcgcggagggtgtcggcgcccaaactgtggtgtcgcgcccgcgg

SEQ ID NO: 4983 - DNA, 201 bp, Homo sapiens
ataattcatttttgggtatatacccagtaatgggatggctgggtcaaatggtatttctagttctagatccctgaggaatcgccacactgacttccacaatrgttgaactagtttacagtcccaccaacagtgtaaaagtgttcctatttctccgcatcctctccagcacctgttgtttcctgactttttaatgattgccat

SEQ ID NO: 4984 - DNA, 201 bp, Homo sapiens
caagcagtattgccatagttgagcagaatttatcatatgctaaaagggaaggaaattgtataaatttgccacttgcgtattctactaaagatgaatgtggkaagcaaataaacttgttaaaatatgagaaatctaatttatattttagaaaattatattgtttccctctaaatttaaattgctcagtgactttaagtttat

SEQ ID NO: 4985 - DNA, 201 bp, Homo sapiens
tttcatagctgatagttcttcattattcgttaatctgataatacagccaatatttaattgagtgtatggtacaatgctagatgctggcaagggtatccaaycttttggctaccctaagccacattggaaaaagaataattgtcctggggcacacataaaatacactatcaacagctgatgagctttaaagctcattcaaag

SEQ ID NO: 4986 - DNA, 201 bp, Homo sapiens
cctgactcctgtttctttaccttaatacttccaatataatataacataacataatatataatgtaaatatttctccttaagaatttttttctcttattctycataagacttcacttaacagaatgtctgttaaattagcttaagtaatttagcttcagacaagctttttttcctttctttttattttaaattttaggtaca

SEQ ID NO: 4987 - DNA, 201 bp, Homo sapiens
gaactggagatcattatgttaagtgaaataaggccgccacagaaagacgaattttacatgttctcactcatatgtgggagctaaaaaaaatagctttgatracgtagacaagaattgacagaatagaattgatgaagtagacaagaatacatatgtatacatgatatatgtatatccttcttgttatatttcaagttctat

SEQ ID NO: 4988 - DNA, 201 bp, Homo sapiens
agatataatgagttataatatgtgataaaattagtggatcttcttcttctctggccttccaagtttcctattgtctgcattccagtatcctttcctattcytcattatgctaactagttttcctaacataggaaccaaacattcagttaatattttagatgccccttactattcaaactctcccttaatatctaaaattca

SEQ ID NO: 4989 - DNA, 201 bp, Homo sapiens
ctttgtcagttagctatgagatgcaaaatagcatctacttactaaggaacttttgtactttgtagaatatctttgatatttagttgacccttggttctcaraaaataagtggcttgtaatttgaccttttgctctatcatgttttcttttttataatctgcttgactttgatgagtgtttttccaatgtttcatttgtttt

SEQ ID NO: 4990 - DNA, 201 bp, Homo sapiens
catgcattagggctcataattagttcataaaagtagaattttgagaaaccttttctatacagttttgtctcactttttttttttcatttttatagtcacaraagatataatgagttataatatgtgataaaattagtggatcttcttcttctctggccttccaagtttcctattgtctgcattccagtatcctttcctatt

SEQ ID NO: 4991 - DNA, 201 bp, Homo sapiens
aatatttagcatagcacttttcacataacttgattataaatgatgatgttgaggtgtggttcattatactttggtaaattattttaaaagttagtagctaytcatataaagatttaaacattggctgggcacagtggctcacacctgtaatctcagcattttgggaggctgaggcaggtggatcacttgagctcaggagtt

SEQ ID NO: 4992 - DNA, 201 bp, Homo sapiens
tcaggaggctaaggcagaaaaagtgcttgagcctgggaggtcaaaagagtttagtgagccatgactgggccactgcactccagcctgggccacagagtgakatcccatatcaaaaaaaaattaattaattagttaattaaaaataaagtataatctgaacaaaaagtcaggttcctttttattgtgatttaaatttcaatg

SEQ ID NO: 4993 - DNA, 201 bp, Homo sapiens
tctcagcattttgggaggctgaggcaggtggatcacttgagctcaggagttggagaccagtctgggcaacaaggtgagacccacatctctacaacaaacaraaaattagctgagtgtggtggcatgtgcctgtagtcccaactactcaggtggctgaggtgggaagagtgcttgagagcctgggatgttgaggctgcagtg

SEQ ID NO: 4994 - DNA, 201 bp, Homo sapiens
gtgagccatgattatgccactgcactccagcctgggcaacagagcaacaccctatctcaaaaaaaatatttaagtgttaaaatatatagttataattcctrttttaatacatcgaagatgccatatattctggcatttgatatatatggcatttaacatataatttatttaaattgatatttaatatactgaatgtagcat

SEQ ID NO: 4995 - DNA, 201 bp, Homo sapiens
caactatctcaatggactttctcagccagggcgcttttaaaatgtaacctgagagactgattcaggccataaggggaagtgggtgttggacatgcctcatwatacctctctggcattaacgtcaacacagaccttaaagtctaataagaaacatgtaccctaaaacttaaagtataataataataaaattaaaaaaaaaag

SEQ ID NO: 4996 - DNA, 201 bp, Homo sapiens
ctccttctacatcccattgccttcccttgcttacaataaaattgtcttaaatatttcctctacacacatttgaaaccatgtcatacagtattagaattttyacatcagctagcaaatataatttagaaaacttaagaggacaaggaaaacttattgtctttacccagatttttacttactgagttctttttccttcataat

SEQ ID NO: 4997 - DNA, 201 bp, Homo sapiens
atttttcatttaactatttcaattatttatttgtccatatgccttatctttattgcttttaagtctgttttgttttataaggatagcctgagctgtctgawtactatcaataagctggtgtttgttattttcagggaatccttcctgtggattatcttaacaacactgatctcttcaaagcagagagcatgtttacaaatg

SEQ ID NO: 4998 - DNA, 201 bp, Homo sapiens
gcttctattaacaggtaattttaaatgaaagtggcatatatatataactaaaaaataatgcaacctgggacttctataccttttgttctgtaccttattawttttttttctttttgagaccaagtctcactctgttgcctagactggagggcagtggtgtgatctcggctcattgcaacctctgcctcccaggttcaagcg

SEQ ID NO: 4999 - DNA, 201 bp, Homo sapiens
gtcgcccaggccggaatgcggactgcagtggcacaatctcggctcactgcaagctcctttattgctttttttttttgcatttattcctgaaatggcgggamtctgtcccagaatttgagagaggagtgggagctgactgccccgtgaatgtagtctggcatgtatctgtaatgtttatagtgttgtggtgattgccatgga

SEQ ID NO: 5000 - DNA, 201 bp, Homo sapiens
ctttcactaccttctctttttttaacctatttcatctttgtctttaggtgctgagcacagtgctctccatgtatgttgtgtatagcactcagagtagtctrctcaggaagcaaggactgcctctcatgaatcaaattattagctgggcaacattaggtaagaggccactcaaaccaggtgaggtaatttgacatcaactta

SEQ ID NO: 5001 - DNA, 201 bp, Homo sapiens
gcctcaaatgatatgtaatttagtacctttatgtttttaaagggaataccatcagatcttttggtaaattagtaaatttagtgaaatttggtaagtattcytttaagcagatttagatcacatgtatagttcagtaatatagtaaataatggtatttctgtggaatgcttggtctactaatgttgctgtggtttatttaat

SEQ ID NO: 5002 - DNA, 201 bp, Homo sapiens
tcatgtcacaaagtgaaggtatgttttgagatattttggacaaatgttttagcatgctttgctgacatgaatacccactggtactgactccagaattgaarctttagtatttcattatcctgtgttattgaaagaatttgggttggatggaagcataattttcctagatattactcttgaaagttcaaaaataattttata

SEQ ID NO: 5003 - DNA, 201 bp, Homo sapiens
atgagccctagattaggatttaggaaacctgtttttcgtttctagtttgtgattcatcctgggtaaattttgatctttcattgaccatggaatcagactcytgtagtaatggaccatatgagatgtaggaaagcctttgggaaaatgctgttcaaatgtaatacatttataataacaaagtggatgattttttaaaaaata

SEQ ID NO: 5004 - DNA, 201 bp, Homo sapiens
aaaaatgagaaggaaacattaataatcaaaattatctttaattggcctcacagggctaaaatctagaattattattactcttgggtaaactcatgaaaagyacttaatattcattctataaagaaacaaaaagaacctttgagatgtgtctcttattcatttccttgggtacacttaaaacgggttacagttactgctcaa

SEQ ID NO: 5005 - DNA, 201 bp, Homo sapiens
ttaactatatatggatcaactctttaaaacaaactattttaaaaaatatttagttgtaagttagttcttctatatttgtcttattattctttatatcttawttgtaggttcccatggggctggtcatccttcagagactttaactcctttagtcacttggggagctggaatcaagtatccccaaagagtatcagctcagca

SEQ ID NO: 5006 - DNA, 201 bp, Homo sapiens
gtgctgaatcagatccaccaatttccaggtgaggactgcagaccaaagataaacatttttcttttttctaccaagaccccaataaaaataaacaaacttascaaaatgaaaagagtgggagaaggactatcagcaaatttgagttcaacaaatttctagaagatagataaccagagggaggaaacagcagctgagaaacta

SEQ ID NO: 5007 - DNA, 201 bp, Homo sapiens
aggaggtccagggacctcagactcagtgagacagtaatgtggaaggaggagtgaggaagggaagcaggagattaattggatatctgcctaccaaatgatgrtatcaacaggctctccatagcccgtctccttccttcatccccatggagaaagtgctacaggcattttattccaagtagaaaaccagaagacacctctaaa

SEQ ID NO: 5008 - DNA, 201 bp, Homo sapiens
ttcattgctatgatatatgtgcctccactttagtaaggctgttctccattctagcatgtgtagcctcctcctaacaaaggacagagacaggcatccctccygctcatcctaaaacacgacacagcaattcttattacatgcatagaacttactggtggccttcctattcgtgagtgagacctagagggaaaagaaactttc

SEQ ID NO: 5009 - DNA, 201 bp, Homo sapiens; identical to SEQ ID NO: 1271

SEQ ID NO: 5010 - DNA, 201 bp, Homo sapiens
ccattggcacccgagagggagctccttactgctgcctgccagggaccagcgttacggcaccctgcaaggcctccactactgccttcatgactgggaaagayagaggtcccctttgcctcccatgcaacctccactaataacatggtcaggaaaggaatggcctttctacctctgagtggaggtggaattcctggctctcca

SEQ ID NO: 5011 - DNA, 201 bp, Homo sapiens
tttatcctcaggttcatggatcctttcctgtgccccctcagttctgctattgagcacttccatggaaatttttattttggttattgcattttttagttctwgacttctttatttgcttcttatttacatcttctttgctgagaattcctatttcttagctcagattttctgtttttttgtgtgtttgtttctagtatgtac

SEQ ID NO: 5012 - DNA, 201 bp, Homo sapiens
acttggtgatgctccatctctggagacagatagctacttcatcaggaacttaagcataaggatgtataactggtatgggacattccagtcctggaagtgtrtgactcttaacacatggccactgctttcagggaggttatggcctaatataggtttaaagacataatgataatgattatagtataaggcaacatgtggtta

SEQ ID NO: 5013 - DNA, 201 bp, Homo sapiens
gttttacagagtagaaactggttctgaaagactgattgcacaataatgtggcatagctaggtttattttttgcattgtgtatgtgtttaataaattgatcrtttttcagaaaaaaatacatattgaacactcaccatacataaagcattcccagacattgtcaagtacccagagatgaatggactgccagccttaagactt

SEQ ID NO: 5014 - DNA, 201 bp, Homo sapiens
cttcaaaactgaaatttatctttaaaaaaaacttctgtgcatcacatacctacatagaaaaatattattcatttattcacttatgacatgaagggtgataygattctatatcattggtcatgctaaaggaatgaaaattattctagaaataactttttatcctgctttctctgtctttatactcttaaaatatttttccct

SEQ ID NO: 5015 - DNA, 201 bp, Homo sapiens
aaaatatgtgcatatattgctttgataaaacttatttttaaaagtatgtttatcaaaataaatagatattctaatcattggcacaaattcagtagaatatktaattggaaaaggatactattcataatagaaataaaatacccagcaataaaataatgagaaatgtatattgtaaagaaaactgtcaaattttattaagga

SEQ ID NO: 5016 - DNA, 201 bp, Homo sapiens
attacagaatagaatgcaaatgttagcagccttgaaaatgtacaagtgcagttaacaggttggaaggcagagagggaaggaaatgtacatggaatagtagyggtgctattgtcttcatgaaatagaatatggagaattttatctttagttgaattcgtcagaggtttaggtattagtttttgttttgttttgttttgtttg

SEQ ID NO: 5017 - DNA, 201 bp, Homo sapiens
tatcttaacaacactgatctcttcaaagcagagagcatgtttacaaatgcagtacagattcttgaacagttcaaggtaaaaaaaaaattcaaaaaggcacrcacaaaaatggacaatactacaatttaaatattgaatatatttagggaaaatatttgattttgtttttaactatttccctgtaatttacctttaaatttt

SEQ ID NO: 5018 - DNA, 201 bp, Homo sapiens
acaacagtgctttctagaatacctcctgaaggacctgcctgaggatattttacagttaaatttatatatatatatatatatatatatatatatatatatatggaaaaggagtacagtctaaaaaacgatgaaaaatatggtatagtaaatgtagatactggtaacagttgtttattgtcattatcagatattatgtactgt

SEQ ID NO: 5019 - DNA, 201 bp, Homo sapiens
tagtgtagctagaatggtatgagggaaaacatggtcaggagagaattcatagagtagatatttgctatcacttatggcctttgaaagtcattgtaaagaaytgggagtttattccaagtgtaagttgaagcattagtttgttgagcagaaagttattttatttgcttcacatttttgacataacactggccacaatgtaaa

SEQ ID NO: 5020 - DNA, 201 bp, Homo sapiens
caccatacgatagggttcacatgtcaaaacttcattattgtactttttctgctttctgtttgtgagaatgttgcatttaagttttgagtttccaattattyttgtgtgaaggtacatttgaaaagctgtggtgtttcttgtcatgtcgctgatattataaactgaccggcagagctcccttcacaggtgccggggttattg

SEQ ID NO: 5021 - DNA, 201 bp, Homo sapiens
gttcatgcatcttcataaacatctagtttattgcgaggaaaaggcttggataatggtggggaagtagggggaaatgtacgtcaagattcaaaactaaagcmccatacgatagggttcacatgtcaaaacttcattattgtactttttctgctttctgtttgtgagaatgttgcatttaagttttgagtttccaattattct

SEQ ID NO: 5022 - DNA, 201 bp, Homo sapiens
attgttttgccacagaaaaacttctacccaaacctgggaaaagcaggttaagttaaacagtgattgggaaaagttaaggattattgagaaaggtattaaaytgatgataatgatattactagagtagaatatcatttattgtatgcagtgtattaggaattgtacttatgttatctcattgagtctcatgaaatgatgtga

SEQ ID NO: 5023 - DNA, 201 bp, Homo sapiens
gaggggagtgcgaacagctgaactcatttcaagttgaaatttgatgttcctttaactctgctatggcgagatgacaccaagacttgattgatgcaagatawcacaagctggatgccttatggctcaattgcatgaagatgatgagcttcacaactgtttcctgccaattatgttagcttacatgagccaagagtcagtaat

SEQ ID NO: 5024 - DNA, 201 bp, Homo sapiens
aatcagtttaattactctctgtcaaagaaggattttgaaggcattatgtggggcccaaatggagttaactcattcccagagcagagtagaggcagagagcytcccacaaggtcacagcaaggctgtgcattgctacacagagtccacatacccaacagttgtttatctgagatcggagtcctgaaagacgtgataaaggct

SEQ ID NO: 5025 - DNA, 201 bp, Homo sapiens
ccagagcgcctgggtttgaatctcatttctgccacttttgagctgtgaaacctttgctaagtgacttaatctctctaagccccccgtttctcttgtagtcrttttgaatgaattaatttatataaagcatttaagtatttagcatagtgcctggcatctaataagcttcagtgaatgtcagcaattgttactgttgtcatt

SEQ ID NO: 5026 - DNA, 201 bp, Homo sapiens
gcctgggccacagagtgatatcccatatcaaaaaaaaattaattaattagttaattaaaaataaagtataatctgaacaaaaagtcaggttcctttttatkgtgatttaaatttcaatgattgccataacctgttaaatttcttttctttgagaagaagaaagcaaaattgacccttttgccttttcttctccaaatgcat

SEQ ID NO: 5027 - DNA, 201 bp, Homo sapiens
ctttaataattcatttaacaaatattgattaagtgcctataagaccttgcatgagacgttagagatgcaatgggaaaagagataaaaattatagtccctgyttccacagagctcacaggccagggtagaggccagcaacctatgccctttagccaaatgcagcccacctcttgattttgtacagcctgtgaactaaaaaaa

SEQ ID NO: 5028 - DNA, 201 bp, Homo sapiens
ataatcagcaattgaacatagattcagttattgctctctgaattgtcagtctgttggcaaacactcctgcttcaaatctccatcaaatgagaatctctttktctattcattccttctactaacactgtgatgtgtctgtggtgtgtttcaactttgtgctaagtctaagtatttagtggtgagttaaggcagacataatcc

SEQ ID NO: 5029 - DNA, 201 bp, Homo sapiens
aatttaatttgttcctctgtttctttacaaatagagactacaagcacaatattaaaaaagttgatgatggagttaaagaaatcgtgtctatgtttaaccayttctatggaaatgatgggaaaacaacatttatctttacctctgaccatggaatgacagactggggttagtgtgtctttaattgatatgtaccttacaatt

SEQ ID NO: 5030 - DNA, 201 bp, Homo sapiens
agaaataattttattgcaggaaaataataataactggctattatttctatctcttgctggaatttaacaaagagaatttttatgttcatgcatgtgttaaraagataatttgatagaatatttatgagctgataataaagctatgtatttattaacatctcataagatttgactaagtgattccaaaagagataagggtga

SEQ ID NO: 5031 - DNA, 201 bp, Homo sapiens
gtgtggcagtcttaaatataatgtgttcaaaacatgatattatattttatatcaaaagcactttagggaatgaaaatattctatacttgaaatgatacttktaatgtggccaaacagtttagtttatgtagtaagagtgagagacatgaacgtcatctatctcatttaggacctaaaaagggtttattaaaatatatttgt

SEQ ID NO: 5032 - DNA, 201 bp, Homo sapiens
cccttcttaaacgtgatgcactgctgtaattgatggaatattcatatcgaatgaaccttgttcagttgtgtggcagtcttaaatataatgtgttcaaaacrtgatattatattttatatcaaaagcactttagggaatgaaaatattctatacttgaaatgatacttgtaatgtggccaaacagtttagtttatgtagtaa

SEQ ID NO: 5033 - DNA, 201 bp, Homo sapiens
ctattgggttagctgccagtgatgaatacctcacaatccccttcttaaacgtgatgcactgctgtaattgatggaatattcatatcgaatgaaccttgttsagttgtgtggcagtcttaaatataatgtgttcaaaacatgatattatattttatatcaaaagcactttagggaatgaaaatattctatacttgaaatgat

SEQ ID NO: 5034 - DNA, 201 bp, Homo sapiens
acaacttctgttgcactagtgtgatattcataaattagaaaggcggccgggcacggtggctcactcctataatcccagcactttgggaggccgaggcaggyggatcacaaggtcaggagtttgagaccagcctggccaatatggtgaaaccccgtctctactaaaaatacaaaaattagctgggcatggtggcgggcacct

SEQ ID NO: 5035 - DNA, 201 bp, Homo sapiens
aattagtattgtatctagcaaataaattgtatacatttttgtataccataattcaataacactccttatatatgacagcaagtatttttctcacttttgargaccataagtaaaaggaagataccatgttatactcttatttctgactttgcatttggtttaaattagcctaacagtggctgtaaagcctattgggttagc

SEQ ID NO: 5036 - DNA, 201 bp, Homo sapiens
gacaacagtgctttctagaatacctcctgaaggacctgcctgaggatattttacagttaaatttatatatatatatatatatatatatatatatatatatatggaaaaggagtacagtctaaaaaacgatgaaaaatatggtatagtaaatgtagatactggtaacagttgtttattgtcattatcagatattatgtactg

SEQ ID NO: 5037 - DNA, 201 bp, Homo sapiens
attatttattccttgtgtattccctttaattagtattgtatctagcaaataaattgtatacatttttgtataccataattcaataacactccttatatatracagcaagtatttttctcacttttgaggaccataagtaaaaggaagataccatgttatactcttatttctgactttgcatttggtttaaattagcctaac

SEQ ID NO: 5038 - DNA, 201 bp, Homo sapiens
ccccttcctctgtttctataattgcctatattttccaatgataacactccctccatcccccccttacacacacacacacacacacacacacacacacacacacccctgataatttgatggaattatttactacagcctatgccttgtgaggaggagtttatctccagcacctaagacagtgatcggcacacagtaggtagt

SEQ ID NO: 5039 - DNA, 201 bp, Homo sapiens
accccttcctctgtttctataattgcctatattttccaatgataacactccctccatcccccccttacacacacacacacacacacacacacacacacacacacccctgataatttgatggaattatttactacagcctatgccttgtgaggaggagtttatctccagcacctaagacagtgatcggcacacagtaggtag

SEQ ID NO: 5040 - DNA, 201 bp, Homo sapiens
atgtggctataaaatggcatcatgagagatctttgtgctgatgggaacactctttaccttgacagtatcagtgtcattgtcctgcttgggatattatactrtggttttacaagatcttcccactgggggaaactgggtaaagggtacagaggatccctctgtattatttcttgaaattgcatattagttaacaattacctc

SEQ ID NO: 5041 - DNA, 201 bp, Homo sapiens
ttattaaaattatttttattaattttcagaaactttttgtgttatttgtttttatcttaaagtctatggatttcagctcctgccagagtttttttttttttcttctacagttatcatatctaccaggtctcattcacctagatcagatattacagatctggttattgtcaagatttgcttcttccatcattattttgttag

SEQ ID NO: 5042 - DNA, 201 bp, Homo sapiens
acagtcactgatgtttcttgattataacactagcctaaaagatttgctactcttcactgtatccacaataaagttcaggctttttaaaaaaaaaaaaaaamaaaaaacggagtcttactctgtcactaggctggagtgcaatggcacaatcttggctcactgcaacctccacttgccgggttcaagtgattctcctgcctc

SEQ ID NO: 5043 - DNA, 201 bp, Homo sapiens
cttttattgtgcctggtttatgccatattttcctgtaactttggtagacacttctatgcaaacaactctaagatgtgtttttccaaacttgacccctttcrtgacctcgaggaccacatgtctaacattctgctgggcatcaccaaatatgtgtcccaaactgactaacaactgccactcctcttcaaagtcactctctct

SEQ ID NO: 5044 - DNA, 201 bp, Homo sapiens
gttttccatgtgtagtttcccatgcattttcttgttgggaaaatagcaccatgtatttttaattgccatttccatcatcagtcctatcttctccttccgcyattatgtatgtttattatggcctggataattggagtaagaaaaatgccacaggatataggtcccagctactcaggaggctgatatgggaggatcacttga

SEQ ID NO: 5045 - DNA, 201 bp, Homo sapiens
cttaatagtggtgttaagtactttaacctccctgaactatagttttctcatgtaattcacattaaaaatttttttgaactatagaaaagtataaataattwtatgtatgtatatatatatattcctgctattcagatattagccattagtactttgtcacatatgttttttaaaaatgtgtttttaagaagttaaaacatt

SEQ ID NO: 5046 - DNA, 201 bp, Homo sapiens
gtctttgaagagggaagaattatatagggattttaaaatgaagcatttatataagataagaaaaaactcaattctcacttttattacacatatagcaacastacaactgtgttctatatattattagcaacatattttaccttttggcacattttattaaggtgtaattaaaccctagggaaagatttattgtttattgtt

SEQ ID NO: 5047 - DNA, 201 bp, Homo sapiens
caaccaaccatataagatctgaaagggatgatttttcagttctgtgtttgattaaatactcaactgtacaagagccatggctacacggcagggattggggraaaaaaaacacaaaaacttggaaatagcagttgtcaacaatgtgatctagcagccaaaaagctagttttctcatgccctctattaattgaagtgaaaata

SEQ ID NO: 5048 - DNA, 201 bp, Homo sapiens
catttcttctttgtttttgtgtccattttacactccagcctgtaggtgtaccacacatttaatcattccccggtggacatgtaggttgttttctgtttccygcttctgtaaacaatattacaacagatatctttataatggaaattgtagcacatgtctgcttattttctcagggtaaatttttagaaatggccttattgc

SEQ ID NO: 5049 - DNA, 201 bp, Homo sapiens
ccaatcagctaatactattaaagcactttacccactgaaccttgcatttccctaaattataatttcatcttgtcctttctgtttaattttttgaaagaaawatttatagttgctgccattattttctctccatgtatatgccatatccgcaaacctctaacaatgcctggcacgtagcagtgctctatcagtatttgtcag

SEQ ID NO: 5050 - DNA, 201 bp, Homo sapiens
gataaggaagattttttacttatcacagaaaagcacaattttgttgttgtataggttgggcttttcttagtgattacttgaggatcattgatttaaaaaastcaatataagtgaaggaatacagaaaagaatgctttttatcttattttcttcatatttcacatccaatttttccttccgtcaatttatcttggaagaatt

SEQ ID NO: 5051 - DNA, 201 bp, Homo sapiens
agggaggtcaaagctgcagtgaactatgatcataccactgcactccagcctgggtgacagagcaagaccctgcctaaaaaaaaaaaaaaaaaaaaataggraaaaaaaaagtattttgttgaatgtgtggcttgcaagtgttttatcccagtctgtagcttgtctttttaccctcttaacagggcccttcacagagcaaaa

SEQ ID NO: 5052 - DNA, 201 bp, Homo sapiens
agtttttaatctatataaggaagcagaagttaaaataatttctattctaacctaccatttcagggagacttgtgagttttattaagagatcacacccagargttgacttaaggaaataaatgtttgaaagcgtccagaaatatgtactaaattctgtacagtctcttaataggcctttctcttttttgaactttcaaattc

SEQ ID NO: 5053 - DNA, 201 bp, Homo sapiens
ttaaaaagttcacatgaagcttttaagcacatataagcatttcattacagtgatttttatgttccttgatcatagtttacactagttcttttgctccagcstaataaatcactcagcacctgtaatataaaatgatattttctgtggtaaaattttagaaaaatgacataaacttgtcagtttgcaaacactatagtgttt

SEQ ID NO: 5054 - DNA, 201 bp, Homo sapiens
tataactctaaaaaatgtagtattgatgcaggccaaacatatagatttagtggaactgattcgtgagtacataaagagataagattcacttgtctacaacrtgcaccttgacttatgatggggttacatccctaagttgcaaataatgtaagtgcaaaatggatttaatacacctaacctactgaacatcatagcttagtc

SEQ ID NO: 5055 - DNA, 201 bp, Homo sapiens
agctgattagatgatgcccacttgagggtgggtctgcttctcccactccactgactcaaaggttaatctcctttggcaacaatgtcacagacatacccagraacaatactttacatccttcaatcaagttgacactcaatattaaccatcacagtaggcaaagaagagagctgactttggtgagcagcagattttgctgtc

SEQ ID NO: 5056 - DNA, 201 bp, Homo sapiens
cactctgtgagtcacaggaaacacctccctcgttaccctgagccactcagttttttttttttctggataagtatgtatttattatagattattaaaaatayagtcagtcttgattttcttccttcagctacatagggaattacaatgtgcttctacaaagaatgcacttatatttccactttgatactttttgatagaagt

SEQ ID NO: 5057 - DNA, 201 bp, Homo sapiens
atggcccagaatatgatctatcttggtatatatgagcacttgaaaagagcatgtattctgctgttgttgggtagagtgttttatcattgtgaattaaatcytgttgtttgatagtgttgagttctgtattcttgctgattttcagtgttgttgttctatcaatttttgagaaaagggtatctttgctctgaagtctgtttg

SEQ ID NO: 5058 - DNA, 201 bp, Homo sapiens
catattttctgatgagaaatctgctgttattcaaattgtttttcccctataggtaaggtgtcatttctcactgctttcaaattcttttctttgtttttagwttttagtaatttgatgtgtctttgtgtggattgctttgggtttaccttatttgaggtttgcttagcttctgtaagatttatgtcttttgccaaatttgga

SEQ ID NO: 5059 - DNA, 201 bp, Homo sapiens
caatgaaaagtggtccagttctgaaatatttaaaaaaataaattattcttaaactggtaacagtattactatattatttttgactcttgccaaaatatgtsttcaatctgctgtattttattaagttagatgtgggattaacaacattatgagatctctatgaaattatgatcccctttctaacatctttttttggcctta

SEQ ID NO: 5060 - DNA, 201 bp, Homo sapiens
aaattttcttaggggttaagtagaatgtatatgaaagttagggggcaattttatacttttgagaaggatgataggttatatattgtattaatttatttctrttcttgaatagtttctctaattgcaccatttgtgttttttaacatagtagtgaagagttatttgaaaaaaatacttaaatacttcagacttttgttgaaa

SEQ ID NO: 5061 - DNA, 201 bp, Homo sapiens
aaaaaaatatatatatatatatatgcaaaatacagaatttactgtcttaagcattttaagtgtttgcagacagtccccagcttaacaatggtttaacttaygattcttttgactttccaccagtgcaaaagcaatacatatttagtataaaccggacattgagtatccatacaaccattttgttttttactttcagtatag

SEQ ID NO: 5062 - DNA, 201 bp, Homo sapiens
atctgttgaccccttcaaactctttggcaataagcaatatttattctcttagaagttgagaaaaatactcatagtttatgaataagagaagtgaaatatckgaattttcttcttatgttaagaaggtttgtacaacacacatcatctattttagattgtagcattctaaggggcacacatgttttgaatagtttaatcctt

SEQ ID NO: 5063 - DNA, 201 bp, Homo sapiens
atggtagttttctatttttatgtatgtaatgtatgtgttgatttttacacatatttttacatttttaacatttctgaaatagggatgtttaattacagtawttttttttccttcttagttatacttgagatattggcacatcatacagttagatagtattttggattcaattaagtggtatatagcactatcgcttaacag

SEQ ID NO: 5064 - DNA, 201 bp, Homo sapiens
cataatataaaatctattagttttgcatttattcactgactaatgtaattgttattatttgaagaatagttctttaggggcttattgtaccatgtgtatawaactattactgcttgcttgctttctgaaggatggaaggaaaatcctgtagagtttgattctctttttaatgaaagtaaatacacatggagctggggaagc

SEQ ID NO: 5065 - DNA, 201 bp, Homo sapiens
tgaacatctgtataccctttacctagtatgacaattttaaccttttttcataattgcgttcaccctctcctggcccctctgccacctgcaccacaggggtrcccatgtatgtccatctagttataattattttttccttaacaattcgaaagcaagaaactttaccccaaacacttcagcctatatctcttaaataaccac

SEQ ID NO: 5066 - DNA, 201 bp, Homo sapiens
cttacatatctcacagttcagatattcatttgattcagagaaccttcagaatattttcccaaaacttttaaagatttttatttaagattgaaattttcttrccaaaacaaaacaaaaaatcagcagcttgacttggggtaaatcccaaagcattttctagaactcagtgaagacagggatatactctgtccattaactttg

SEQ ID NO: 5067 - DNA, 201 bp, Homo sapiens
aaaggattatttgatgaacatctgtataccctttacctagtatgacaattttaaccttttttcataattgcgttcaccctctcctggcccctctgccaccygcaccacaggggtacccatgtatgtccatctagttataattattttttccttaacaattcgaaagcaagaaactttaccccaaacacttcagcctatatc

SEQ ID NO: 5068 - DNA, 201 bp, Homo sapiens
tgatttgcatttctctgatggccagtgatgatgagcatttcttcatgtgttttttggctgcataaatgtcttcttttgagaagtgtctgttcatgtccttygcccactttttgatggggttgtttgtttttttcttgtaaatttgtttgagttcattgtagattctggatattagccctttgtcagatgagtaggttgcga

SEQ ID NO: 5069 - DNA, 201 bp, Homo sapiens
atgctaggaatgggctcacctggaatttgaaaaattcctttccttcttaagttttgacttaagttttttgcttttgattccttctgtaataatcttatgtktctaaagctttatgtgagagtatctaatcatagtctgtgttaactatttgtctttaatatcttttaggaatatcataatgcatgaaggcagctggggcat

SEQ ID NO: 5070 - DNA, 201 bp, Homo sapiens
aaaaaatcagtttctgaggagtaagttgtctttgaactaagatataaatgcctaattaagcaaagagtgctaaatcttgagtaatacttttatttcattaraaaataattcatttttgggtatatacccagtaatgggatggctgggtcaaatggtatttctagttctagatccctgaggaatcgccacactgacttccac

SEQ ID NO: 5071 - DNA, 201 bp, Homo sapiens
tctagagcactagggggattagaaagttatgcacatttccttcccagaatagagatggaggagtttatgttttgccaccccacccacttcatctgcccttyctccacttgggtagttgcttttattatcccgggggagagtcgatacatctctcatgcatggtgaagtcattcctgtttctcttttccaaggggcatactg

SEQ ID NO: 5072 - DNA, 201 bp, Homo sapiens
ttggtctaaagtatactttggtatcaggattgcaactctagatttcgtgctgtttccatttgcctttatttttagcctttttgaatcactgtgttttaagwttagttcctgtattctgcgtagagttaggttttgctttatatgccaattcgacaattttttttcttttaactaaaaaggtgagttgagctcattcacatt

SEQ ID NO: 5073 - DNA, 201 bp, Homo sapiens
cttaagattgctttggctattcagagtcttttgtgggcccacatgaattttaggattttttctatttctgtgaaggatgtcataatttttgttttatataygttgtttgaagcaaaatattcataactattacattatcattgtggaatgttacttttaacatcacaaagtgttcttctttgctttattgattgtttttgg

SEQ ID NO: 5074 - DNA, 201 bp, Homo sapiens
acattttgactcctcctttcctagcgattgtgtagatctagataaattaaactttgtagttaaatctaatacggttatatttacacacagagattagtctrtatttttcacatgtgctgtggttctacctgtaagtgcttcctcacaggttgtacttaaaatagagtgtattgttaacattgtagaaaacattagaagtaa

SEQ ID NO: 5075 - DNA, 201 bp, Homo sapiens
taagcctttaatccattttgagttgatttcttttttatgtggtaagagataagtgtcttgttttattgttttgaaaatggatattccattttcctagcacygtttattggagagacagtcctttcctcaatgtatgttcttggtgcctttgtctaaatgagttggctataaatatgtggatttatttctgggttctctatt

SEQ ID NO: 5076 - DNA, 201 bp, Homo sapiens
tgaattgacgttttagaatcacatgatttcaagaatcatcagaaatgtattttttctcatatgaatattaaatatcatacattttagagaaaaggaatggrcattttttcatcaactgattagtgtgaatttttggtagagtcagaaacgtatttttaaactttaattagcttattgaatgaaattttattatacaaatat

SEQ ID NO: 5077 - DNA, 201 bp, Homo sapiens
tgggtagtttgcaaatattttctcccattctgtaggttgtctcttcactccgttgatggtttcctttgctatgcagaagctttttagcttgatataatccmctttgtctacttttgcttttgttgcctgtgcttttgaggtcttacccaaaatgtctttgtcagactactgtcctgaagtgttttccaaatgttttcttct

SEQ ID NO: 5078 - DNA, 201 bp, Homo sapiens
agaattgcttgaacccaggaggtggaggttgcagtgagccaagattgcaccactgcactccagcctgagcgacagagtgagactctgtctcaaaaaaaaaattaacttaaaaatatcaaaaattaatattaatattaaaatgcttaaaatattaactataaggcaaaaagacactgatcaaataacatattgttacctctc

SEQ ID NO: 5079 - DNA, 201 bp, Homo sapiens
taattggttgcttttctgttacatgatttgaagaacacattctagctggggcaaaggaagtaattaggaggctatttgcaatgttctacattagagattayggttggactaggttgatagtacacaggacaatgaaaagtggtccagttctgaaatatttaaaaaaataaattattcttaaactggtaacagtattactat

SEQ ID NO: 5080 - DNA, 201 bp, Homo sapiens
gtgcatcgtgacactatgcataattttattctaatttttcttaactttagctttgactgcttcttccttcttttaaaacatgatgtattaaaaatatttcrgagttggctgggtgcaagggctcacgcctgtaatcccagcactttgggaggccaaggcaggtggatcacttgaggtcaggagttcgagaccagcctgacc

SEQ ID NO: 5081 - DNA, 201 bp, Homo sapiens
cagcccactacagatatggtccaccttgctcatattagggaagaggaaaataacttactaggaactgagtgaggatgacctctcaggcctcattattctcrgtacacagcctcttcaatctggctgttttaaaatgcattcacaaggagttataatggaatgttcattgaaaacaattcatggtacaagtaaaagagcaaa

SEQ ID NO: 5082 - DNA, 201 bp, Homo sapiens
cttagaagggtttatgaatctagtttatcattatttaattagcataataatcttcaaattttattttaattaattattcccagcctcaccctgccaagtartattttattaattggttgcttttctgttacatgatttgaagaacacattctagctggggcaaaggaagtaattaggaggctatttgcaatgttctacatt

SEQ ID NO: 5083 - DNA, 201 bp, Homo sapiens
ctttccttcttaagttttgacttaagttttttgcttttgattccttctgtaataatcttatgtttctaaagctttatgtgagagtatctaatcatagtctrtgttaactatttgtctttaatatcttttaggaatatcataatgcatgaaggcagctggggcatatctcatacacgtgtgccaacagaatctcggccaggt

SEQ ID NO: 5084 - DNA, 201 bp, Homo sapiens
ctcacctggaatttgaaaaattcctttccttcttaagttttgacttaagttttttgcttttgattccttctgtaataatcttatgtttctaaagctttatrtgagagtatctaatcatagtctgtgttaactatttgtctttaatatcttttaggaatatcataatgcatgaaggcagctggggcatatctcatacacgtg

SEQ ID NO: 5085 - DNA, 201 bp, Homo sapiens
ggccatgctatcatcttagagggcccatgaataaaccttagagggaatcctaaggctttaggaaaccgctgcagcttgtctgtcattttccaatatgttarttattatacttagtgtacagtatttagaatacaaaatgcttttttattttttaggaaaataatgttataaatgattgtatattttcatagtaatgtcttt

SEQ ID NO: 5086 - DNA, 201 bp, Homo sapiens
tattttgtttcatgattctgtgcagtggttgaatggttctttgtttggtcttacatcagcaaattcatgctgctgcattcagctggtagatgctaggaatsggctcacctggaatttgaaaaattcctttccttcttaagttttgacttaagttttttgcttttgattccttctgtaataatcttatgtttctaaagcttt

SEQ ID NO: 5087 - DNA, 201 bp, Homo sapiens
tggggacacttagggtgtctctctgagtcttgtagcttaaggaaggcttttcagaacaggagctgtctgaacactgcaagtgtggggcttacaagagtacrttgggtcacaagaactagggagaatgtgtagagtgagagaaggtgaagagcagagaacaagaagtgtggaaacaaggctgaaagaagtggccagaaggca

SEQ ID NO: 5088 - DNA, 201 bp, Homo sapiens
ttttaagaatttttcaactaaacaaatttgaaaggattatttgatgaacatctgtataccctttacctagtatgacaattttaaccttttttcataattgygttcaccctctcctggcccctctgccacctgcaccacaggggtacccatgtatgtccatctagttataattattttttccttaacaattcgaaagcaaga

SEQ ID NO: 5089 - DNA, 201 bp, Homo sapiens
attacacactggcttggaaagtactcccatgttccgtttgatcttggcaatttaatggtatcttcttttacagttttatttaaatgtttcatattgcttcrtttttcttccttaagtatttgtaagttcatcagctctgtgatgaacttacagagaactcgatattctttatagtaccccagcacccagttatgcatgtga

SEQ ID NO: 5090 - DNA, 201 bp, Homo sapiens
aaaaattagctggctgtggtggtgcatgcctgtggtctcagctactcaggaggctgaggtggaggatcacctgagcccagggaggtcaaagctgcagtgarctatgatcataccactgcactccagcctgggtgacagagcaagaccctgcctaaaaaaaaaaaaaaaaaaaaataggaaaaaaaaaagtattttgttgaa

SEQ ID NO: 5091 - DNA, 201 bp, Homo sapiens
caatacttttttttttctcctcgatctgcagagattcaccaacaatagcaaattacacactggcttggaaagtactcccatgttccgtttgatcttggcartttaatggtatcttcttttacagttttatttaaatgtttcatattgcttcgtttttcttccttaagtatttgtaagttcatcagctctgtgatgaactta

SEQ ID NO: 5092 - DNA, 201 bp, Homo sapiens
gccgttacattacaactaagacaagttccaatacttttttttttctcctcgatctgcagagattcaccaacaatagcaaattacacactggcttggaaagyactcccatgttccgtttgatcttggcaatttaatggtatcttcttttacagttttatttaaatgtttcatattgcttcgtttttcttccttaagtatttg

SEQ ID NO: 5093 - DNA, 201 bp, Homo sapiens
aaactttatagagtattgccttttatacggcatactgaaagtacatttttaaaactagagaaaaaaattcctttgaggtaattttcataactataaaaacrtatattcagatttgcgtcctcaatgcatttgtagtgaggtgaatagagtcaggatcatcagtttgattgagctgagtttgatttgatggcagtcttcatt

SEQ ID NO: 5094 - DNA, 201 bp, Homo sapiens
aaagttaaggattattgagaaaggtattaaattgatgataatgatattactagagtagaatatcatttattgtatgcagtgtattaggaattgtacttatrttatctcattgagtctcatgaaatgatgtgaagaaaatattaacaatttctgttttacagagtagaaactggttctgaaagactgattgcacaataatgt

SEQ ID NO: 5095 - DNA, 201 bp, Homo sapiens
tcccaggttcaagcgattctcctgcctcagcctcctgagtagctgggattacaggcacgtgccaccacgcccggctaatttttgtacctttggtagagackgggtttcaccatgttgaccaggctggtttcgaactcctgacctccacctgcctcagcttcccaaagtgctgggattacaggcgtgagccaccgcatctgg

SEQ ID NO: 5096 - DNA, 201 bp, Homo sapiens
taatttgaagaatttttcacaatatttgaatctttaattctacattgagaattatatttaagaaaataacacaaatatattcagaattattttacattcayattgataatttagcatttaatgttcattaggttgtttagtaaaaaaacataaaatttactttttaaaaaaattaaggacagtgattattattctaaactg

SEQ ID NO: 5097 - DNA, 201 bp, Homo sapiens
aagtaaagcacaataagatgtggtatgcctgcatctagaatatattaagaaccattatggttctgtgacaagaacacaatctaattaaaaaattaaatccrtacaaatggtagatcagtaagcctatggaaagatactcaataatattagtcattagggaaattatattaaaatcacaacaagctaccagtacacacccac

SEQ ID NO: 5098 - DNA, 201 bp, Homo sapiens
gatacctagggggaattttagaagctttcaaggactttttattagctctcttcctgccatattccccaaaataagtaaaatttctctttgacttgatgctrcattaactgtactttttagtgaactgggggaaaataaataaagttcaaatatatactcattccaccaatgaatcataaagtgactgcactatgccgttag

SEQ ID NO: 5099 - DNA, 201 bp, Homo sapiens
acagtgaactttacagaggacaaactgaacaaaccgcctcagccaagtggtcaagttttatattaacagtttagtaagtcatgttgacagtacccttaatrtgatgtgaagaaaatggtactttatgtatgtatgtttcctctcctgaacccataaccccagacttaccatgagaaaaacatcagataaatcccaatagca

SEQ ID NO: 5100 - DNA, 201 bp, Homo sapiens
catcagtggattaagggataaagaaaatatggtatatatacatgatgcgtcttgtatattgcaatattattcattcataaaaaagaatgaaatcctgtcayttgcagcaacatgggtggaactggagatcattatgttaagtgaaataaggccgccacagaaagacgaattttacatgttctcactcatatgtgggagcta

SEQ ID NO: 5101 - DNA, 201 bp, Homo sapiens
attgtcttaaggtaaatatgacagtatcaagcaattagggggatttagagatatagaagctttcgtacattgctggagagtatgtaaattagtatggacamtttgccagtcacttgtaaagttgaaaattttgtttattagagcaattccacttatagaggtggctttcaatcttattggtccatagaataatttaaaata

SEQ ID NO: 5102 - DNA, 201 bp, Homo sapiens
tgtttgtgctatcaacctagaagcaaggaagtgctaggcatttgcattcattaagagggaactgataaaaatttgctattggattctgaatattataaaaraaatattaattgaaataaaaataatataaggaagttaagtagaaatttagcttatatgagtaatctaggaattttagtttgaaaattttctttgtaaaat

SEQ ID NO: 5103 - DNA, 201 bp, Homo sapiens
ctctctatatgatgcttcatgcattagggctcataattagttcataaaagtagaattttgagaaaccttttctatacagttttgtctcactttttttttttcatttttatagtcacagaagatataatgagttataatatgtgataaaattagtggatcttcttcttctctggccttccaagtttcctattgtctgcattc

SEQ ID NO: 5104 - DNA, 201 bp, Homo sapiens
tacaaacgtgtatatttatatacacatatgtacaaacgtgtatatttatatacacatatgtacaaacgtgtatatttatatacacatatgtacaaacatgtatatacacatatgtacaaacgtgtatatttatatacacatatgtacaaacgtgtatatatacatgtatgtacaaacatgtatatttatatacatgtatgt

SEQ ID NO: 5105 - DNA, 201 bp, Homo sapiens
tttagagtagtctctcttgtactgtggggacacttagggtgtctctctgagtcttgtagcttaaggaaggcttttcagaacaggagctgtctgaacactgsaagtgtggggcttacaagagtacattgggtcacaagaactagggagaatgtgtagagtgagagaaggtgaagagcagagaacaagaagtgtggaaacaag

SEQ ID NO: 5106 - DNA, 201 bp, Homo sapiens
atacaaacgtgtatatttatatacacatatgtacaaacgtgtatatttatatacacatatgtacaaacgtgtatatttatatacacatatgtacaaacatgtatatacacatatgtacaaacgtgtatatttatatacacatatgtacaaacgtgtatatatacatgtatgtacaaacatgtatatttatatacatgtatg

SEQ ID NO: 5107 - DNA, 201 bp, Homo sapiens
ttgtgtcatcatctcagattccaatatatcttcatatttgacaaagatatttgcatgttttatttccatacattttgactcctcctttcctagcgattgtrtagatctagataaattaaactttgtagttaaatctaatacggttatatttacacacagagattagtctatatttttcacatgtgctgtggttctacctgt

SEQ ID NO: 5108 - DNA, 201 bp, Homo sapiens
cgtgtgtgtgtgtgtgtttatacacatatatacaaacgtgtatatttatatacacatatgtacaaacgtgtatatttatatacacatatgtacaaacgtgtatatttatatacacatatgtacaaacatgtatatacacatatgtacaaacgtgtatatttatatacacatatgtacaaacgtgtatatatacatgtatgt

SEQ ID NO: 5109 - DNA, 201 bp, Homo sapiens
atatggtttgttgccactgccaatatggtatgcggttctaagagagtaagtaatgcatcttgctgccttgttttttcacttcattgacagttaaatctgtrtttaaaatgcagtagatttctgtaccataagtcatcaaatatatttataatactgtactttcaaacctccagtccctctcacttcatttataactgcata

SEQ ID NO: 5110 - DNA, 201 bp, Homo sapiens
tcgtgtgtgtgtgtgtgtttatacacatatatacaaacgtgtatatttatatacacatatgtacaaacgtgtatatttatatacacatatgtacaaacgtgtatatttatatacacatatgtacaaacatgtatatacacatatgtacaaacgtgtatatttatatacacatatgtacaaacgtgtatatatacatgtatg

SEQ ID NO: 5111 - DNA, 201 bp, Homo sapiens
attaccattggtttggaagtgtttcaatgttttgtttgatttttcagaaaccaagccatctcctgccttgtagttttgtagctattggcattttagtagcrttttttctgctgattcaagcctgtccctggacatattatgtatatggtttgttgccactgccaatatggtatgcggttctaagagagtaagtaatgcatc

SEQ ID NO: 5112 - DNA, 201 bp, Homo sapiens
ttcgtgtgtgtgtgtgtgtttatacacatatatacaaacgtgtatatttatatacacatatgtacaaacgtgtatatttatatacacatatgtacaaacgtgtatatttatatacacatatgtacaaacatgtatatacacatatgtacaaacgtgtatatttatatacacatatgtacaaacgtgtatatatacatgtat

SEQ ID NO: 5113 - DNA, 201 bp, Homo sapiens
ctatatgtagctaatgccgttacattacaactaagacaagttccaatacttttttttttctcctcgatctgcagagattcaccaacaatagcaaattacasactggcttggaaagtactcccatgttccgtttgatcttggcaatttaatggtatcttcttttacagttttatttaaatgtttcatattgcttcgtttttc

SEQ ID NO: 5114 - DNA, 201 bp, Homo sapiens
attcgtgtgtgtgtgtgtgtttatacacatatatacaaacgtgtatatttatatacacatatgtacaaacgtgtatatttatatacacatatgtacaaacgtgtatatttatatacacatatgtacaaacatgtatatacacatatgtacaaacgtgtatatttatatacacatatgtacaaacgtgtatatatacatgta

SEQ ID NO: 5115 - DNA, 201 bp, Homo sapiens
tgtttttccaatgtttcatttgtttttgcaaggttattttgccatcctttccttccatgatgtgattcttcaggccaagaagaaaaagatgtgtctgtagytaaaattacctcatccttggtgtttttcagcctaggatcactatatgtagctaatgccgttacattacaactaagacaagttccaatacttttttttttc

SEQ ID NO: 5116 - DNA, 201 bp, Homo sapiens
aattgggtctggcagaccctggtgatggtatgctgaaggatgaccagcaggtggagctacatgaccaggagaggcataaaaggatcacccatctgtaaaaggaggaaaaacactttatgtttaaaattgtatactttagaggctggagtaagacaagaaataatttaaaagaaaaaatgccacagaataagaagaaagcaa

SEQ ID NO: 5117 - DNA, 201 bp, Homo sapiens
cgcccatacataagctgttacgtgattcttcatagcagctttatttgaaatagccaaaaacttttagaaacaacacaagtgtctgttaacatgagagtgawtaaacaaattatgctatatctgtgcaatggaataatgctcaataataaaaaggaacaaacatatatgattctaaaagtatttatgctcagtggaagaatt

SEQ ID NO: 5118 - DNA, 201 bp, Homo sapiens
ttcaccatcttagccaggatggtctcgatattctgacctcgtgatccgcccgcctcggcctcccaaagtgctgggattacaggcgtgagccaccacgcccsgccaagcctgtctttttaattatattcatcctgccccttattcagtttttctcaactgaataatccattctcttgttagttcatcatgggttccattctg

SEQ ID NO: 5119 - DNA, 201 bp, Homo sapiens
ggaccagaacaccatgcaaatatgagctttgaaaataacgtaataaaggttatctccaacaggaaaatacaactgggtcaggtttattattaggtgtaccrtagtccttttttcgttgggacctctgtgttgtttctagagtagaaaaggtctaatgtctaaaatctactataataatcaaaacaaaagagcaagtcatga

SEQ ID NO: 5120 - DNA, 201 bp, Homo sapiens
tgaaagcagtgactcacgcctgtcatctcagcactttgggagtccaaggcaggaggattgcttgagcccaggagtttcaaaaaaaaaataataaaaaaatwagaagaagaaatgaaagcacacgcccatacataagctgttacgtgattcttcatagcagctttatttgaaatagccaaaaacttttagaaacaacacaag

SEQ ID NO: 5121 - DNA, 201 bp, Homo sapiens
ccaccacctcgcccggctaatttttttgtatttttagtagagacggggtttcaccatcttagccaggatggtctcgatattctgacctcgtgatccgcccrcctcggcctcccaaagtgctgggattacaggcgtgagccaccacgccccgccaagcctgtctttttaattatattcatcctgccccttattcagtttttc

SEQ ID NO: 5122 - DNA, 201 bp, Homo sapiens
ctcccaggttcaagcgattctcatgcctcagcctcccgagtagctgggattacaggtgcccgccaccatgcctggctaatttttgtatttttagtagagayggggtttcactatgttggtcaggctggtctcaaactgctgaccgcaggtgatccacccgcctcagcctgccaaagtgctgggattacaggcgtgagccac

SEQ ID NO: 5123 - DNA, 201 bp, Homo sapiens
tgcagtggcgcgatctcggctcacaagctctgtctcccgggttcacaccattctcctgcctcagcctcccgagtagctgggactacaggcgcccaccacckcgcccggctaatttttttgtatttttagtagagacggggtttcaccatcttagccaggatggtctcgatattctgacctcgtgatccgcccgcctcggcc

SEQ ID NO: 5124 - DNA, 201 bp, Homo sapiens
atgaaagcagtgactcacgcctgtcatctcagcactttgggagtccaaggcaggaggattgcttgagcccaggagtttcaaaaaaaaaataataaaaaaawaagaagaagaaatgaaagcacacgcccatacataagctgttacgtgattcttcatagcagctttatttgaaatagccaaaaacttttagaaacaacacaa

SEQ ID NO: 5125 - DNA, 201 bp, Homo sapiens
ctggagtgcagtggcgcgatctcggctcacaagctctgtctcccgggttcacaccattctcctgcctcagcctcccgagtagctgggactacaggcgcccrccacctcgcccggctaatttttttgtatttttagtagagacggggtttcaccatcttagccaggatggtctcgatattctgacctcgtgatccgcccgcc

SEQ ID NO: 5126 - DNA, 201 bp, Homo sapiens
ttcaaggactttttattagctctcttcctgccatattccccaaaataagtaaaatttctctttgacttgatgctacattaactgtactttttagtgaactrggggaaaataaataaagttcaaatatatactcattccaccaatgaatcataaagtgactgcactatgccgttaggtggtgagcatgagtgaacagaaaca

SEQ ID NO: 5127 - DNA, 201 bp, Homo sapiens
atagagttaaagaaaccagatatgtaagagtatatagtgtactccatttatataaaattctagagcaggcaaaactatagtcacagaaagttgaccactgrttgtttggggctggcagttggggtatgattgaccacaaaagggcctgtaggaacttttagggtgacagaaatgttctatatattgaagttgtttttagtt

SEQ ID NO: 5128 - DNA, 201 bp, Homo sapiens
tattgatgcgtggatacacaggaaaaaaacacactttttcaaaataatcatgtactacttctgaagtactttgtgatgtgatatattctatattttatccratcctattgtactgtattctatttcattttttaaaaaaaggaaagaaggctaattgcagtccatgaaattattttgttatgggtcactactctacagttt

SEQ ID NO: 5129 - DNA, 201 bp, Homo sapiens
acatggatgactatcagatactttatagagttaaagaaaccagatatgtaagagtatatagtgtactccatttatataaaattctagagcaggcaaaactrtagtcacagaaagttgaccactgattgtttggggctggcagttggggtatgattgaccacaaaagggcctgtaggaacttttagggtgacagaaatgttc

SEQ ID NO: 5130 - DNA, 201 bp, Homo sapiens
tctcagcctcacttgcattcgtctatcaaaggggataaggaaagtacacagaattgagaatgttcttgtcccagtgcctggtacctgctacacaataactrttactgtggtcacttattaattattgaaatattagtatgtgttgagaacatttgacaagtgtttaaaaataaaactaatatcaatcgttttggcagtgca

SEQ ID NO: 5131 - DNA, 201 bp, Homo sapiens
tagtcacttggggagctggaatcaagtatccccaaagagtatcagctcagcaatttgatgatgcatttttgaaaggtacaagcatttctttactggtttayaaatacaacctcttaaaataagaacaaagtttaaatttttaagaaatcactcttcaaattttagttgtaaatccctcattttgacatttgtgccattact

SEQ ID NO: 5132 - DNA, 201 bp, Homo sapiens
acacagtcaaacacagaagagataacatgtgaacctaagggagaatatggccatttacaagctaaggaaagagacctcaaataagaccgatgctgctcacmcacgatcttggacttccagcctccagaactatgaggaaatttatattgtttaagccactcaatctgtgggactttgttatggcaaccctagctaatacac

SEQ ID NO: 5133 - DNA, 201 bp, Homo sapiens
cttacttctgggttcttcagtttccacagaatggttcaagaatatgaagatttgctctggaaaatcattttccttccttttaattaagacttagttcaggsatcgtattctctgttaaaccttttttacccaactgctccactctccagaatccttccaccctcaaatttctggctaagttaggtaactcagactgtggct

SEQ ID NO: 5134 - DNA, 201 bp, Homo sapiens
aaatagcaaaagccaagatttgaatgtaaaggtttaaaacctttttctttctgatgtgtaattttatcatagtaaattctacactagtagcagtactaatwcttgtgagctggttaaaaacataagctgatgtctacctcacaccatatacaaataattatttttgtttcagaggacacaaaccaacacaaataaatttta

SEQ ID NO: 5135 - DNA, 201 bp, Homo sapiens
aaacaatttatctgttccctatggttagatattgtttccaattttttattattacaaatagcaaaagccaagatttgaatgtaaaggtttaaaaccttttwctttctgatgtgtaattttatcatagtaaattctacactagtagcagtactaatacttgtgagctggttaaaaacataagctgatgtctacctcacacca

SEQ ID NO: 5136 - DNA, 201 bp, Homo sapiens
ccacgactcctccatgattggtcagagaaggaaggcgtggagcggactgacgggagactggcccgagaattatcgcgatagcagcagcggccgggcaggtrttgggggcgttccggaattgaggggtggttgtagtggtggcttaggaataccctcccggctatcgcttcagtgggtagaggggaccactgcccgagagct

SEQ ID NO: 5137 - DNA, 201 bp, Homo sapiens
ttgtgaacactaaggatttagtaggtagtagacaaggctcatgggaaatgttatgaatttggttttaaacctacttagttgagtgtctttgaaacgtccaygtagatttataaaggttcgagttacatatgtggatttggagctataatttgttgaggcttttgcatattaggtaataactgaagccacagatatgatgaa

SEQ ID NO: 5138 - DNA, 201 bp, Homo sapiens
ttttcttttccacaatacacagaggtttggttattcgtgaataatgtataagtaacacacactggaatattaaaaattaccgatcactacttataataatktattattaatagtgttgggaaatttcctttctacttagtaagattttcattaatctaggcccttacaactaatgtttcatctgactaatgatagttatta

SEQ ID NO: 5139 - DNA, 201 bp, Homo sapiens
aaattgggtctggcagaccctggtgatggtatgctgaaggatgaccagcaggtggagctacatgaccaggagaggcataaaaggatcacccatctgtaaaaggaggaaaaacactttatgtttaaaattgtatactttagaggctggagtaagacaagaaataatttaaaagaaaaaatgccacagaataagaagaaagca

SEQ ID NO: 5140 - DNA, 201 bp, Homo sapiens
ctcaaatgcctctttttcactgaaaattgtcatgattcgtacttcctcttcggcgttgcctcaccatttctgtgggtgtctatggtaatgaaagagctaaygcttatcaagccctttcagtgggctaggcaccattttaagtgctttgctagcagtaagttcttggacactaagattaatatcaatgttttattgctttac

SEQ ID NO: 5141 - DNA, 201 bp, Homo sapiens
tttcaacggattgaatgaggactacccagattatctaggataatctcctgtacttaaagtccctgacctttacaccatgcagactatcactagtgaattasattgatgaattctctgttttggcaggtgattgggaatagtgcatatgactgaatgaagtttctattgggtgggcaatagagagagaagcttagatagctt

SEQ ID NO: 5142 - DNA, 201 bp, Homo sapiens
aaaattgggtctggcagaccctggtgatggtatgctgaaggatgaccagcaggtggagctacatgaccaggagaggcataaaaggatcacccatctgtaaaaggaggaaaaacactttatgtttaaaattgtatactttagaggctggagtaagacaagaaataatttaaaagaaaaaatgccacagaataagaagaaagc

SEQ ID NO: 5143 - DNA, 201 bp, Homo sapiens
tttttcccttgaaattttctttttacttttaatatatacttttgtcaacagggaaaactttcaacttaaataaaatctgtgtaagaaaatgattagcaaaytattttgctaatcatcacttcttaacttaatgtgctaatattaatatctgcatgaaatcctttggcttctaatttcatatgtgtagctaaaatccctcca

SEQ ID NO: 5144 - DNA, 201 bp, Homo sapiens
tttgttaatggaattggttctgaggaatatataaatgttcatatgtttttcaagaaatattgattgactagtatgtgttttgcggatatagcagtgaacargatagacaaaggctttgcattcatagagtttatttgtacagtagtgtcacaggcaaactataaccaaatgaagaagtgaataaggaatacattatcaatt

SEQ ID NO: 5145 - DNA, 201 bp, Homo sapiens
tagccttcagtctgtggccaaaggcccgagagcccctagcaaaccactggtgtaagtccaagagtctaaaagctgaagaattcggagtctgatgttcaagtgcaagcagcatccagcgcaggagaaatatgaggctggaaaactcagcaagtctgctcattccacattcttctgcctgctttattctagctgtgctggcag

SEQ ID NO: 5146 - DNA, 201 bp, Homo sapiens
aaagaagccagtctgagtcccaaaacctcaaaagtagggaagctgacagtatagccttcagtctgtggccaaaggcccgagagcccctagcaaaccactgrtgtaagtccaagagtctaaaagctgaagaattcggagtctgatgttcaagtgcaagcagcatccagcgcaggagaaatatgaggctggaaaactcagcaa

SEQ ID NO: 5147 - DNA, 201 bp, Homo sapiens
ggtttggcttgttttattttcagagttaaggaagtacagttttaattacagtatgttactttgcaagattgatatgtttaattctcagcttattgagatartaagaaaatgttaaatttttctttaaatatttatgaaacaatatagtaacataaaattccatttattttcaaagtggttaaccatccctaaagaatcatt

SEQ ID NO: 5148 - DNA, 201 bp, Homo sapiens
gaattgagcttttttatttgtaggctgatattgcaccattgatgacttcccttattggagttccctttcctcttaactcagtggtaaggaataaaattttrttatcaactctcagtataaaaaaaaactatcgcacagtaaaatgtactcttttttatgtgtttctgaataatctgggttttttttttagatggggtcttg

SEQ ID NO: 5149 - DNA, 201 bp, Homo sapiens
cattctagtaggagaattaaagcaactataaacaaaacttacacattatgataattttatgaagaaaattagggtgatatgataaaagaggaggtaggacygggctcctttctccaccctgccccccccgccagtttccttagagacaggttcttgccgtgtctctaaaggaatggaatgggctggaatgtagtagctgtt

SEQ ID NO: 5150 - DNA, 201 bp, Homo sapiens
acagtagcttcaaaacatcttggagatcaaataataccatataactaacctgacttcaataaaattattgtatttagagcaagggaatgataaccctatcsttcttaaaattagatcaccatgaatattgaatagtgtattacatttatgccttcgcatttgagcaacatatgaataaacgagggaaccagggacacattc

SEQ ID NO: 5151 - DNA, 201 bp, Homo sapiens
gatgaggttagaaatccaggttccccttgcagcctccattggcacccgagagggagctccttactgctgcctgccagggaccagcgttacggcaccctgcraggcctccactactgccttcatgactgggaaagatagaggtcccctttgcctcccatgcaacctccactaataacatggtcaggaaaggaatggcctttc

SEQ ID NO: 5152 - DNA, 201 bp, Homo sapiens
caatggaaagaagatatcctttcagagttggcactgctaaactggaggtgagaccctctatcccttactccaaaccacagttaatctttttgctttactcwtaagtgcatttgacttcaaaagagtagggattcaactgttaatctgagaggatcttatcagatgtgattaaagcctgtgggaagctatggatcaaactgc

SEQ ID NO: 5153 - DNA, 201 bp, Homo sapiens
attgccaacataatcttttctcataagccatgtacctggaattgatcaattcattcaacaaatgtgtcattttctgctatatttagtaatgtgccagataytagctgggtgctgacagtacaaagataatgaccattttcagctttccaggggttcagattcttcattagaatgtaattcatgttcttcttctctaaggtc

SEQ ID NO: 5154 - DNA, 201 bp, Homo sapiens
ctttctgactgtgttcagtccttttatgatgggagccctgatgatgtggaaggttagttttcttattttgttatttgtcttaagctattgattgattaagrttataaagtcatttagacagagttaagtagcaatggaaagaagatatcctttcagagttggcactgctaaactggaggtgagaccctctatcccttactc

SEQ ID NO: 5155 - DNA, 201 bp, Homo sapiens
ctgggattacaggcatgaaccaccacgcctggccaacactgttgttttaatattggcaaatatgatatatcaccattgttttcatttccatatgttatcartaaggtcaaacataattttcgtgtttgtgttcttgttgcgcccatttttttgaaaatttagagtgttccttttcctcttctatgtatgttaataatttta

SEQ ID NO: 5156 - DNA, 201 bp, Homo sapiens
aatctttccttctgcccagtcttcagtgttataattttataatttgtaatagcgtttaaagtgtttggttttttttgctttcttatctttaggaaatagtrgcgtatgctgtagagttcagtagttgaaagactcaaaaaggaaataaggctttgttttgttttgtaacttctgattagataaataactcactcagcaaat

SEQ ID NO: 5157 - DNA, 201 bp, Homo sapiens
ctgtacttgttttactcatgatattttctcatgtgtgtaggtatctgttcatatccctgggccttctaagtcttatatatcaagtgatttgtgtatgcttyctgaaacctgaatctttccttctgcccagtcttcagtgttataattttataatttgtaatagcgtttaaagtgtttggttttttttgctttcttatcttt

SEQ ID NO: 5158 - DNA, 201 bp, Homo sapiens
gaaaataacttactaggaactgagtgaggatgacctctcaggcctcattattctcggtacacagcctcttcaatctggctgttttaaaatgcattcacaakgagttataatggaatgttcattgaaaacaattcatggtacaagtaaaagagcaaattactctcaaggtaaaattagcatatcttttctaaatgaaaagga

SEQ ID NO: 5159 - DNA, 201 bp, Homo sapiens
tgcttccttcaaaataaatagttcactttgtatagaatgtgggaggtttgttcgagggactgataagaaataatacaatatagattaggccgaagtaatcmaaggcttcaaatgctggactacagcatttacactttatttagtgaggagtttggtacgttaataaaaaccagagaaatagaaccaggctatatatatata

SEQ ID NO: 5160 - DNA, 201 bp, Homo sapiens
ttatatttaaggtatgtcttctgtaagtagcacataattgactttgttgtttgtttttttatccagtattctactttttttcttttagttggtgttttcgsaccatttatacttactataataactgatatatttaggtttgttttcaatttatcccatctgttttatgttcctttttctgttttattttgtttttttgta

SEQ ID NO: 5161 - DNA, 201 bp, Homo sapiens
gtcaatgcctggacttatattagtataatgacagcagcattgtttatatttgtgtgttatgtcttttctcatatcctttcacttttaacattttgatgttyttatatttaaggtatgtcttctgtaagtagcacataattgactttgttgtttgtttttttatccagtattctactttttttcttttagttggtgttttcg

SEQ ID NO: 5162 - DNA, 201 bp, Homo sapiens
caccctatcttaagacttttgccttaaagtcaatgcctggacttatattagtataatgacagcagcattgtttatatttgtgtgttatgtcttttctcatrtcctttcacttttaacattttgatgttcttatatttaaggtatgtcttctgtaagtagcacataattgactttgttgtttgtttttttatccagtattct

SEQ ID NO: 5163 - DNA, 201 bp, Homo sapiens
gtctttgcattctagtgtgtcattggcaaatgcccttgccaatgccctcaccctatcttaagacttttgccttaaagtcaatgcctggacttatattagtrtaatgacagcagcattgtttatatttgtgtgttatgtcttttctcatatcctttcacttttaacattttgatgttcttatatttaaggtatgtcttctgt

SEQ ID NO: 5164 - DNA, 201 bp, Homo sapiens
agttaattaacgctgcaaatatcccagagactttatagatgaataatttatcattattatactatattatatctaaaacttgtattattttggaaaaagargaaagataggtctagagggaactggaaggaatctaaactctttggtgtcaatgtttaaactgctttcttgaaaagaaaacatattctctgaacaaagatt

SEQ ID NO: 5165 - DNA, 201 bp, Homo sapiens
tagagactcatgtttaattcaagccaaacagtttccagatccatgcagttttctactcacctgtttttttgtaactgtggttaaaaaaaaaaatatatatrtatatatatgcaaaatacagaatttactgtcttaagcattttaagtgtttgcagacagtccccagcttaacaatggtttaacttacgattcttttgactt

SEQ ID NO: 5166 - DNA, 201 bp, Homo sapiens
tgactgatccagatactcttgttttcagatttttttctcatgctgttttaattgtaaactgttatacaattgggttactaaaacccttgatgggttctagyaatcaccaactagtaagtcataaaacttttgtaacttactgtatttcagaattgttattcagattttccaaattattctttgtgagttatgtatgatgtc

SEQ ID NO: 5167 - DNA, 201 bp, Homo sapiens
gtcctggctagagactcatgtttaattcaagccaaacagtttccagatccatgcagttttctactcacctgtttttttgtaactgtggttaaaaaaaaaaatatatatatatatatatgcaaaatacagaatttactgtcttaagcattttaagtgtttgcagacagtccccagcttaacaatggtttaacttacgattct

SEQ ID NO: 5168 - DNA, 201 bp, Homo sapiens
atgtcctggctagagactcatgtttaattcaagccaaacagtttccagatccatgcagttttctactcacctgtttttttgtaactgtggttaaaaaaaawaatatatatatatatatatgcaaaatacagaatttactgtcttaagcattttaagtgtttgcagacagtccccagcttaacaatggtttaacttacgatt

SEQ ID NO: 5169 - DNA, 201 bp, Homo sapiens
aaagaaatggatagggatggattggtatggaaaggtattgcaggccaacagcattatgtaaatcttggtcaagagccagcataatggatttgaggaagtgagaaagaagggaggttagtgtggcaggaggactgcctgggagccaggtctcagaagaggctagagagtgaggtaagggttttactcgaacttcatgtcctg

SEQ ID NO: 5170 - DNA, 201 bp, Homo sapiens
gtacaggagacaaagaaatggatagggatggattggtatggaaaggtattgcaggccaacagcattatgtaaatcttggtcaagagccagcataatggatytgaggaagtgagaaagaagggaggttagtgtggcaggaggactgcctgggagccaggtctcagaagaggctagagagtgaggtaagggttttactcgaac

SEQ ID NO: 5171 - DNA, 201 bp, Homo sapiens
tcaacttaaataaaatctgtgtaagaaaatgattagcaaattattttgctaatcatcacttcttaacttaatgtgctaatattaatatctgcatgaaatcytttggcttctaatttcatatgtgtagctaaaatccctccaaaatcatggaattgattccttgtgaatgtacatacatagctggtagctggcctgattttc

SEQ ID NO: 5172 - DNA, 201 bp, Homo sapiens
atttttctttagaatgtattgagaggcagatatttatcttgaaaaatgttattgttgagtttactattttataacttattgctctgctggcctttcacctrtaatagcaccacttgtagttttgctttcttccccaaattttgcaaatcactgtggatacaacttaaataatgttgacatcttttagcaaaataatctttt

SEQ ID NO: 5173 - DNA, 201 bp, Homo sapiens
aaaatgtttctttaataagtacaaattttctgaagcacagatgaaatttaacttcatatgattctgccaaatgtgatagaatacatgtttcctgctcaatrtggtaatagtcaagagagccagaataccaaagtaagaagaaaaaaaaaatcacaaatatttgaataatttaaatcaattcagcaacatctaaataattat

SEQ ID NO: 5174 - DNA, 201 bp, Homo sapiens
agtagctgggattacaggtgcccgccaccatgcccagctaatttttgtatttttagtagagatggggtttcaccacattggtcaggctggtctcgaactcytgacttcgtgatctgccctccttggcctcccaaagtgctgagattacaggcgtaagccaccgcacccggccgagaaatgatcagttttaatagtgaaatt

SEQ ID NO: 5175 - DNA, 201 bp, Homo sapiens
ttgtcatgattcgtacttcctcttcggcgttgcctcaccatttctgtgggtgtctatggtaatgaaagagctaatgcttatcaagccctttcagtgggctrggcaccattttaagtgctttgctagcagtaagttcttggacactaagattaatatcaatgttttattgctttactaatacaaatgtaagtttcagaaatg

SEQ ID NO: 5176 - DNA, 201 bp, Homo sapiens
tactgaacatcatagcttagtctagcctacctttaatgtgctgagaacacttaacattagcctacagttggtcagaatcatctaacataaagccgactgtrtaataaagtattgaatatctcatgtaatttattgaatactgcattgaaagtgaagaacaaaatgattgtgtgggtactcaaagtatgctttctactgaat

SEQ ID NO: 5177 - DNA, 201 bp, Homo sapiens
acatatacataataatgattatgtgtgataataatcaacataatgtatgtattactgtgtgatatggtttggctctgcgtccccacccaaatcccatctcraattgtaatccccatgtgttgagggagggacctggtgggaggcgattgaatcatggggtggatttcccccttgctgttctcctgatagtgagtgggttct

SEQ ID NO: 5178 - DNA, 201 bp, Homo sapiens
ttcttttgctccagcctaataaatcactcagcacctgtaatataaaatgatattttctgtggtaaaattttagaaaaatgacataaacttgtcagtttgcraacactatagtgtttaccatgaattcatgacatcaatatttagtttatctggcagaatgtagaaaaatgtattaatcactagaaagtatgataattatta

SEQ ID NO: 5179 - DNA, 201 bp, Homo sapiens
gcctcccaaagtgctgagattacaggcgtaagccaccgcacccggccgagaaatgatcagttttaatagtgaaattatggaaggctttttagcttttgccmcctatttgttgctcttccttgtgttccaattggaaaggatgaagggagagaattaattaggtggttgaattggcagaatttagtgaccatatgactattc

SEQ ID NO: 5180 - DNA, 201 bp, Homo sapiens
agtaattgtataggacattcatttttctgttcagctagttgctatgtatgtttttaaaaatattgtgcttacctaaaccacttttaaaaataatgcattakcattaatttaaccgatttaattaattaataatattgggaatttaataggatcagagaaaatatgaataatataagcttctattggataatgcaatggtta

SEQ ID NO: 5181 - DNA, 201 bp, Homo sapiens
ctgggcatgatgctgtgtgcctgtaatcccagctacttgggaggctgaggcaggagaattgcttgaacccgggaggtggaggttgcagtgagccgagatckcgccactgcactccagcctgggcgatagatagggcgagactctgtctaaaaagaaataaaaataaaaaggagaaggcgactgggcccagcaactcacacc

SEQ ID NO: 5182 - DNA, 201 bp, Homo sapiens
tatatatctaatatatataatgtttatgtcattcatgtttagtagtgaacactgtgagtctgtaatcaagaaattttattaatttgattaggggagttgttttcagatcctcttaaaagcttttttgagggggaggggattgaattgcatgacagtttaaaaatggtctcattgtctcatagccatgatttttataggaac

SEQ ID NO: 5183 - DNA, 201 bp, Homo sapiens
ttacagtatttttttttccttcttagttatacttgagatattggcacatcatacagttagatagtattttggattcaattaagtggtatatagcactatckcttaacagctatataatcttgagcaatttatataacctctctgagcttcaatttccttttcataaaatgtgataatattagtttctgtctcatagattta

SEQ ID NO: 5184 - DNA, 201 bp, Homo sapiens
atatatatctaatatatataatgtttatgtcattcatgtttagtagtgaacactgtgagtctgtaatcaagaaattttattaatttgattaggggagttgttttcagatcctcttaaaagcttttttgagggggaggggattgaattgcatgacagtttaaaaatggtctcattgtctcatagccatgatttttataggaa

SEQ ID NO: 5185 - DNA, 201 bp, Homo sapiens
aatatatatctaatatatataatgtttatgtcattcatgtttagtagtgaacactgtgagtctgtaatcaagaaattttattaatttgattaggggagttgttttcagatcctcttaaaagcttttttgagggggaggggattgaattgcatgacagtttaaaaatggtctcattgtctcatagccatgatttttatagga

SEQ ID NO: 5186 - DNA, 201 bp, Homo sapiens
tgtggagaagtgaaaacacgagttcctttgaaaacaaaactcaactggacactgagttttatatatataatgacataaacattatatatattagatatatwaaatatatatatttattatatataaaaatatatatttataatatatatctaatatatataatgtttatgtcattcatgtttagtagtgaacactgtgagt

SEQ ID NO: 5187 - DNA, 201 bp, Homo sapiens
ttaaagagttttaacctttaatctgagttttggggtcagtacctgtgtataaaattcctgaagaacaattagaatgaagtatagtgaacaagtgaaatgtwctacaatttgtagagtaaaatatgtaattactttagatgaagggagaaacttacattgtgtagttttctgcagtttggtagggaaaccatttggaagttg

SEQ ID NO: 5188 - DNA, 201 bp, Homo sapiens
gacatcttagctagaccttgtctggtgaaaaatcatgagataatttagaaatcttagaaataacacaaaaaccaaaaaaaaaaaacaacaaaaaaaaaaaacaaaaaaagacccaccaccacacataacaattttgttacactactgtctcattttatagtcttaaaggtcagcaatgagaaaatcttttcccgaaaaaga

SEQ ID NO: 5189 - DNA, 201 bp, Homo sapiens
atcatcaggcattcgttagattctcataagaagtgcacaacctagatcccttgcaagcacagttcacgacagggttcgtgctcctctgagaatctaatgcygccgctgatctgacaggaggcggagctcgggcagtaatggtcactggtccaccactcacctcctgctttgcagccagttcctaacaggccacagactggt

SEQ ID NO: 5190 - DNA, 201 bp, Homo sapiens
tttcaacttaaataaaatctgtgtaagaaaatgattagcaaattattttgctaatcatcacttcttaacttaatgtgctaatattaatatctgcatgaaakcctttggcttctaatttcatatgtgtagctaaaatccctccaaaatcatggaattgattccttgtgaatgtacatacatagctggtagctggcctgattt

SEQ ID NO: 5191 - DNA, 201 bp, Homo sapiens
aaataaatgttaattattcctcccatttttctcttccccatcataatgaacaatgctttgtgaaaattctggttactcacaaaaatctgtgaatgactagytcatattttatgatagtttaaaagattttgtaaaaagattattttttccaaattttcttttcaggtgctagtggagaccacgtttatacatatagttatg

SEQ ID NO: 5192 - DNA, 201 bp, Homo sapiens; identical to SEQ ID NO: 1267

SEQ ID NO: 5193 - DNA, 201 bp, Homo sapiens
ttcttgacttctttatttgcttcttatttacatcttctttgctgagaattcctatttcttagctcagattttctgtttttttgtgtgtttgtttctagtakgtacataattgctcattaaagtatttttataatgaccactttaaaatttttgccagataattctaacagctctgttatttaggttttgatatcagttaat

SEQ ID NO: 5194 - DNA, 201 bp, Homo sapiens
gcagcacaccagcatggcacatgtatacatatgtaactaacctgcacattgtgcacatgtaccctaaaacttaaagtataataataataaaaaaaaaaaaagaaaagaaaacttccttcagacattcttttaggttaggtctgcaggcaataaattcatttggttttttttttcatctgtgaattctgatttccccttatt

SEQ ID NO: 5195 - DNA, 201 bp, Homo sapiens
ttttatttggaatatgtattgatgtttgctgtcttttacatcgtatagcttattaatgtaggtttttaagtcagtttcatcaccgttctatgtgccattgktatcatgcttttatttcagtgtttgctcttcactagtatatataaaagttacttgagaaattgaaaatatttctgtaagcagaaatagtatttttttcaa

SEQ ID NO: 5196 - DNA, 201 bp, Homo sapiens
agcatataaacataaccaaagacaaaaaccacatgattatctcaatagatgcagaaaaggcctttgacaaaattcaacaaccgttcatgctaaaaactctyaataaattaggtattgatgggacgtatctcaaaataataagagctatctatgacaaacccacagccaatatcatactgaatgggcaaaaactggaaacat

SEQ ID NO: 5197 - DNA, 201 bp, Homo sapiens
aagggataattggaaaaataaagtcctttagtacagtggtccccagtcattttggcaccagggaccagtttcgtggaagacagtttttccacggatggggygaagggtgcaggggccagcaggggatggtttcaggatgaaaccattctacctcagatcatcaggcattcgttatattttcataatgggtgcacaacctag

SEQ ID NO: 5198 - DNA, 201 bp, Homo sapiens
tcaagtgggcttcatccctgggatgcaaggctggttcaatatacacaaatcaataaatgtaatccagcatataaacataaccaaagacaaaaaccacatgwttatctcaatagatgcagaaaaggcctttgacaaaattcaacaaccgttcatgctaaaaactcttaataaattaggtattgatgggacgtatctcaaaat

SEQ ID NO: 5199 - DNA, 201 bp, Homo sapiens
cgtgtttatcatttctcttttgatataatgagaactcaaaaaaaagagagaactcatgattctattcaatagtgtttgtatatcctaaatgtaattaataagtgtcataaaacatctgtactgttacagtgaataccaaactttattaaaaccaatgattctcagactttttctgccccagtacattgaacaggtatgacc

SEQ ID NO: 5200 - DNA, 201 bp, Homo sapiens
acgtgtttatcatttctcttttgatataatgagaactcaaaaaaaagagagaactcatgattctattcaatagtgtttgtatatcctaaatgtaattaataagtgtcataaaacatctgtactgttacagtgaataccaaactttattaaaaccaatgattctcagactttttctgccccagtacattgaacaggtatgac

SEQ ID NO: 5201 - DNA, 201 bp, Homo sapiens
tcactgcaagctcctttattgctttttttttttgcatttattcctgaaatggcgggaatctgtcccagaatttgagagaggagtgggagctgactgccccrtgaatgtagtctggcatgtatctgtaatgtttatagtgttgtggtgattgccatggattttcagaacacttttgagagatttgtcacctgttattaatag

SEQ ID NO: 5202 - DNA, 201 bp, Homo sapiens
aaaccatagattttggctaaaatctataaaaccatagattttggataaaatctataaaaccatagattttggataaaatctataaaaccatagattttggmtaaaatctataaaaccatagattttggataaaatctataaaaccatagattttggataaagaaatttctagaaaatagcctttgggaggcttaagttttt

SEQ ID NO: 5203 - DNA, 201 bp, Homo sapiens
aaaccatagattttggctaaaatctataaaaccatagattttggctaaaatctataaaaccatagattttggataaaatctataaaaccatagattttggmtaaaatctataaaaccatagattttggataaaatctataaaaccatagattttggataaaatctataaaaccatagattttggataaagaaatttctaga

SEQ ID NO: 5204 - DNA, 201 bp, Homo sapiens
ttgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggtaa

SEQ ID NO: 5205 - DNA, 201 bp, Homo sapiens
caggctctatgctgaagagtttgtactccttcactcatctcatctctgactacaaactttggtccctgaagaagttgggatgattatatccagtgtttttktttttttttttttttttttttgagacagggtctcagggtacagtgaggtgatcaccactgcagcttccaccttgtaggctgaagtgatcttcccaactca

SEQ ID NO: 5206 - DNA, 201 bp, Homo sapiens
aatatttttaactcatttgttatatgtaggacttctttcatcatgccagaaacaaccagtctttgttttctaaaataaatgaagagaaaatagtttttttyttacatttattaggaatagatacaaacggacatgctcatcgaccatcctcgaggtaatttaatattgtgtttaattgtattttttagggcaacagctatt

SEQ ID NO: 5207 - DNA, 201 bp, Homo sapiens
atgcactcaacagcatgtcttcagtaagtaatggtgcatttttcagagggcgatttcttatatatttgtaagtgctaatggagagcatcatgccacatcayaggtccacaggggagacattgacaaaaggccagaacagtgtaaccagtacactgccatgattatttccagatttatttaagcatgaaagaaaaagaagct

SEQ ID NO: 5208 - DNA, 201 bp, Homo sapiens; identical to SEQ ID NO: 1344

SEQ ID NO: 5209 - DNA, 201 bp, Homo sapiens; identical to SEQ ID NO: 1346

SEQ ID NO: 5210 - DNA, 201 bp, Homo sapiens; identical to SEQ ID NO: 1347

SEQ ID NO: 5211 - DNA, 201 bp, Homo sapiens; identical to SEQ ID NO: 1348

SEQ ID NO: 5212 - DNA, 201 bp, Homo sapiens
ctgcagttctgggacaggggcattccctgcagaccagacgtgaatgaagccgcttagccagcatcttgtgaacggcctgcctcatgtcctgagccacttayacatgtgttttttctccccagggtctacgaagaatagggtgaaaaacctcagaagggaaaactccaaaccagttgggagacttgtgcaaaggactttgca

SEQ ID NO: 5213 - DNA, 201 bp, Homo sapiens; identical to SEQ ID NO: 1350

SEQ ID NO: 5214 - DNA, 201 bp, Homo sapiens
gcagaccagacgtgaatgaagccgcttagccagcatcttgtgaacggcctgcctcatgtcctgagccacttacacatgtgttttttctccccagggtctaygaagaatagggtgaaaaacctcagaagggaaaactccaaaccagttgggagacttgtgcaaaggactttgcagattaaaaaaaaaaaaaaaaaaaagcct

SEQ ID NO: 5215 - DNA, 201 bp, Homo sapiens
gcagtgatacctaaaaaggacagagccctcagtaaataggcttgctcttttcctggctaaacttttccacatatagagaaaaactatagctaggcaagtgygagaaaggctttacggagccttgtagaaacgtgcaggggcctcaggagatcagcacacaatccaatcaccctctactaaacctctaacccaccccctagg

SEQ ID NO: 5216 - DNA, 201 bp, Homo sapiens
aacatttctctccgactttgtcaaggccctggaaaagcctttgtaattgcccagagagtccttaggacgctggcgagacactctggaagacagtcgggaakgggggtcactgtcccgctccggaacagcgcctccaagttcacccttgctaggattcaaatgagcagtctccctatttgtaccatgggccacccactctgc

SEQ ID NO: 5217 - DNA, 201 bp, Homo sapiens; identical to SEQ ID NO: 1345

SEQ ID NO: 5218 - DNA, 201 bp, Homo sapiens
acagtctctcagggccctgacttagcccagggctactcacaggccacacaagaggcaacatgttattcaggctcctcaaccctccacctcatcctgctccrtttcagcatcaccaccaagagcgtgtccaggtaccgaggtcaggagcactgcctgcaccccaagctgcagagcaccaagcgcttcatcaagtggtacaac

SEQ ID NO: 5219 - DNA, 201 bp, Homo sapiens
tcctggggtcttatgtctgtcctcggagggagaatccagttcctagctcccctgtaccatgcgaaggtagcctgtcctgtctcactcctcagatacgcagmgtctgtttacacatttgcctgcatagcatgatcaggaagcacacacacacacacacacacacacacacacacgcatgcatgcacacaccatgcaggtgac

SEQ ID NO: 5220 - DNA, 201 bp, Homo sapiens
aggttggaggaagtagaagggtatacggtgggctcaggcccatgggggccacacagaggagctctgtgcacttcagagaccagagcttccagggagcttcyggccaccacaggaagcagcctagtcaggcattttatttcaatggataattcagtggtcttactcagaaatcaagaacgagacagaaaagtgataggctaa

SEQ ID NO: 5221 - DNA, 201 bp, Homo sapiens
aggcatcctgggatcccgcggggggtggtctgggtgggcaccaaggtggtcgaggggcaggagaccgcctagcaactaagccgttgccccgcgctcgctcrcagggtccaaatgcaagtgctcccggaagggacccaagatccgctacagcgacgtgaagaagctggaaatgaagccaaagtacccgcactgcgaggagaa

SEQ ID NO: 5222 - DNA, 201 bp, Homo sapiens
cctctctgccttccctgggttctccacacccagaaggactccaccctgtctgctacactagcaactggaagccagtcacccatgtccccttcacctccccrgaagcttcctgaaacactggttctgcacacacttacgaggacacccagcaagtaccctgtctcagcatgtccccggcaagatgctaccacaaacgctttt

SEQ ID NO: 5223 - DNA, 201 bp, Homo sapiens
ggcggggggagaggtccgctttgcaagtgggagtccttgcacccagaaggatccaggagagtccgaattctagaaagagcaatttgtgtcataggtccatrgagctctcaccaaaacccttacccccaccgccagaactgtggaggagagggtcacaggactcagaatttctgatagttgctggagtcacaaatccctatg

SEQ ID NO: 5224 - DNA, 201 bp, Homo sapiens
atacaatgaataaactaaaatcggtggcaacacagagagggactgttgttgggcgtatgctcgtgggattagaactggatggtgaatattggagcccaggmtcactgaggagaagagggttgcctgtcagcccctggggaggagcactgcaggtggaggggccagtgagcacaaagaccctgaggtgggaacaggcttgga

SEQ ID NO: 5225 - DNA, 201 bp, Homo sapiens
cccagacactcacacagccaccaggccactgacccactttaaggagctttcctttgggagtcaccaaaactcctccccaatacccgtccccacccccgcayacacacacataccctctttgagtcagttccagtgatcacagtcaatgactttgctgctggacagtctatgacaagcccctgtccagaactggccttgtgt

SEQ ID NO: 5226 - DNA, 201 bp, Homo sapiens
ggccttgtgttctggcccagcaggggcccttgggggtcaggcctgcaggcactcacacttggcacctgctccaaaaccctttcaggtctttgaggatctgrgccctgggcctgggtctcccgccggctcggaaaagctggcctgccgggccagagagagaaccacacgattcagaaaagcagtgcccttcagcagcctctc

SEQ ID NO: 5227 - DNA, 201 bp, Homo sapiens
ttgttccagtcagagacaagtggaccgcaagtttttggctcctagagattttattttgagaacgctccacgagcttccctcaccgactgtactccttgtgrgtccccaatacggagcagtactgcagaaagtgctctgctggggttaatgtgccacatggctggagccctgcttggtggggatgtggggaatgttggaaaa

SEQ ID NO: 5228 - DNA, 201 bp, Homo sapiens
ccaatcaccctctactaaacctctaacccaccccctagggcctcccactccatccctgagggctgggggctcctctccccctccacaatcctaaaactctscaaatcagatgaggggccagcacttttgcaaagcaggttttcagccacaaaggctgaacaaaagcaaattttccagcttaccctgagtcacccagaaatc

SEQ ID NO: 5229 - DNA, 201 bp, Homo sapiens
gcgctgctcctgctgctgctggcgctgtacaccgcgcgtgtggacggtgagtgcggggagctccccttgtcgccgtctcgtcttgtcctgtcctggggaayccaagcgccaatttctaggcatcctgggatcccgcggggggtggtctgggtgggcaccaaggtggtcgaggggcaggagaccgcctagcaactaagccgt

SEQ ID NO: 5230 - DNA, 201 bp, Homo sapiens
tattttacagtcattttggtcacaatcgagggtttctggaattttcacatcccttgtccagaattcattcccctaagagtaataataaataatctctaacmccatttattgactgtctgcttcgggctcaggttctgtcctaagccctttaatatgcactctctcattaaatagtcacaacaatcccatgaggcattttta

SEQ ID NO: 5231 - DNA, 201 bp, Homo sapiens
tctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaaggtgagtccagg

SEQ ID NO: 5232 - DNA, 201 bp, Homo sapiens; identical to SEQ ID NO: 1413

SEQ ID NO: 5233 - DNA, 201 bp, Homo sapiens; identical to SEQ ID NO: 1374

SEQ ID NO: 5234 - DNA, 201 bp, Homo sapiens
gtctgtttatattttcaagtgcctcgaagtattattgttttatagccaaatgtttagttaatctgctcacagatttaccactttcttcactattcattctktcttacacctctaacattccatctggggtaattttcctaaatgatcatgcatcctttgggatttcttttgatgatggtctattggtagtaaactctctca

SEQ ID NO: 5235 - DNA, 201 bp, Homo sapiens; identical to SEQ ID NO: 1360

SEQ ID NO: 5236 - DNA, 201 bp, Homo sapiens
ctgcgccagtttcaggcaggccgctcctccagggcccagccttgaccatttacctaactgatttttcctctactttccctcaatacctcatagggccgtgyagattaagtaaaatagtaagtgtgaaccacccagcataagctagtcctgggcatcgtaaaggacaatgggaaaagaacacagatcctggaagaaggcccc

SEQ ID NO: 5237 - DNA, 201 bp, Homo sapiens
agagtgaagttcacagaagaaattagggcacagctggaagtgttcaaaatgaggaaacgttcaatgtcaagtttgaggtccagggttgatgggtgaactckgcacgctcagcttcatgttaggtctcccagctcaacgagggggtgaattttggtgtactgctgtctttgaggccctgcgggaactctcccacaccctccc

SEQ ID NO: 5238 - DNA, 201 bp, Homo sapiens
ggagagttcatccaggaaattaggagacagctggaagcctgtcaaagagagagagcattttccgtgaagtttgaggtccaggctccacgctggggcaaccsccgtgcgctcagcttcgtactgagttcgctccagctcggggagggggtggagttcgatgtgctgcctgcctttgatgccctgggtgagagctcccagctt

SEQ ID NO: 5239 - DNA, 201 bp, Homo sapiens
ggcatcgtaaaggacaatgggaaaagaacacagatcctggaagaaggcccccaggtttgaattgtatttgccacctactagctgggtgatggggctgatayattatctcactgagcatccattttcccatctgtaaaatgggaactaatgataatggcatccaaatcatagcatcattgtgagcattataggagtttaaga

SEQ ID NO: 5240 - DNA, 201 bp, Homo sapiens
agctgacacctaagttgtagattttgcccgaacaggtcagttgactggcggctataaacctaacccccaaatctatgtcaagctcatcgaggagtgcacckacctgcagaaagagggcgagttctccacctgcttcacagaactacagagagacttcctgaagcagcgccccaccaagctcaagagcctcatccgcctagt

SEQ ID NO: 5241 - DNA, 201 bp, Homo sapiens
atctcccacagtttgagagctttttgccccaacagggcatctctctaaagcagggtgggaggagatcttaggatctgtcccggggcaagaatgaatacggkcatgatctatcacaggagagacattaaacagcaaattggcataatgtggggacaaagacatttcttacagaacatctgcaaggcttactggttctgttta

SEQ ID NO: 5242 - DNA, 201 bp, Homo sapiens
cctcatgctcactgcctgctggggaatagggcactggggacataccccagggagcccttcctcatgttctgagtcccagttcatcccatgctgctattttkctctcccaggagcatctggactccctagacagagccccagcttctcacctgtccctctctaaatgctgctctgcaggcctgtgatcctggacccggcgga

SEQ ID NO: 5243 - DNA, 201 bp, Homo sapiens
tggtggcttggatggggtgatggcagtggagagggcaggagggaggatcaggaatggacctcaagacttcccagccctgggtctgctgcacttttcaatcwaaccccatggccagggagattgtcccctcagagtgactgaaggaaattcagagaagagctgacacctaagttgtagattttgcccgaacaggtcagttga

SEQ ID NO: 5244 - DNA, 201 bp, Homo sapiens
ctgcacttttcaatcaaaccccatggccagggagattgtcccctcagagtgactgaaggaaattcagagaagagctgacacctaagttgtagattttgccygaacaggtcagttgactggcggctataaacctaacccccaaatctatgtcaagctcatcgaggagtgcaccgacctgcagaaagagggcgagttctccac

SEQ ID NO: 5245 - DNA, 201 bp, Homo sapiens
ttgtagattttgcccgaacaggtcagttgactggcggctataaacctaacccccaaatctatgtcaagctcatcgaggagtgcaccgacctgcagaaagasggcgagttctccacctgcttcacagaactacagagagacttcctgaagcagcgccccaccaagctcaagagcctcatccgcctagtcaagcactggtacc

SEQ ID NO: 5246 - DNA, 201 bp, Homo sapiens
aatgttgagtgactccccttttccagtgtatcatcctctgaataaatggccataggtcctttgggggaaaccattactatatatgctatggtgtcacagcrtcctttcccaaggggactctgcctcctctttgttaatggggtctagtctgaaaactgggttggtcagttccaaaaatcaggaagggatgatgacttttta

SEQ ID NO: 5247 - DNA, 201 bp, Homo sapiens
tagctatatctaatttgctgtaattaattacagttgccatttttatcctaaaatttctatttcatatttttgtatctgccatggtacttcttatggctttkaattccctgctaactatttaaagttcttattttatcctgtgaatatgatattcctagttattttatttttaatttttattatttgttaatcttatgtttt

SEQ ID NO: 5248 - DNA, 201 bp, Homo sapiens; identical to SEQ ID NO: 1406

SEQ ID NO: 5249 - DNA, 201 bp, Homo sapiens; identical to SEQ ID NO: 1394

SEQ ID NO: 5250 - DNA, 201 bp, Homo sapiens
aatccagctgcaatgcaggaagactccctgatgtgatcatgtgtctcaccctttcaagctgaaagcaacagtacagacgatgagaccgacgatcccaggasgtatcagaaatatggttacattggaacacatgagtaccctcatttctctcatagacccagcacactccaggcagcatccaccccacaggcagaagaggac

SEQ ID NO: 5251 - DNA, 201 bp, Homo sapiens; identical to SEQ ID NO: 1367

SEQ ID NO: 5252 - DNA, 201 bp, Homo sapiens
tcacagtgtctaccgtaaatgctcactgaatccagctgcaatgcaggaagactccctgatgtgatcatgtgtctcaccctttcaagctgaaagcaacagtrcagacgatgagaccgacgatcccaggacgtatcagaaatatggttacattggaacacatgagtaccctcatttctctcatagacccagcacactccaggc

SEQ ID NO: 5253 - DNA, 201 bp, Homo sapiens
ggatccagatggcatgtcacagtgtctaccgtaaatgctcactgaatccagctgcaatgcaggaagactccctgatgtgatcatgtgtctcaccctttcargctgaaagcaacagtacagacgatgagaccgacgatcccaggacgtatcagaaatatggttacattggaacacatgagtaccctcatttctctcatagac

SEQ ID NO: 5254 - DNA, 201 bp, Homo sapiens
aagttgattccatgactttgctattgtgaatcgtactgcgataaacatacgagtgccggtgtcttttgatagaatgatttctttacctttgggtagatacygagtagtgggattgctgggttgaatggacattctacttttagttatttgaaaagtcccatgaggcatgttttctatcattcccatcttacagatgagaca

SEQ ID NO: 5255 - DNA, 201 bp, Homo sapiens
cgtatgcagcacgttgggagatagatatttataatttgcaggaacatttggacaggaagtgtaacctctcagaggctcccttgccacatcaggagaattgrtaaaaccacactacctgtatcatatcattattttaagtgataaatgatcatctacattcagctctgatgagtaataggtgttcaaaaataggaacttcca

SEQ ID NO: 5256 - DNA, 201 bp, Homo sapiens
catggccagggagattgtcccctcagagtgactgaaggaaattcagagaagagctgacacctaagttgtagattttgcccgaacaggtcagttgactggcrgctataaacctaacccccaaatctatgtcaagctcatcgaggagtgcaccgacctgcagaaagagggcgagttctccacctgcttcacagaactacagag

SEQ ID NO: 5257 - DNA, 201 bp, Homo sapiens
ttccggcgagtgacggtggtggcttggatggggtgatggcagtggagagggcaggagggaggatcaggaatggacctcaagacttcccagccctgggtctsctgcacttttcaatcaaaccccatggccagggagattgtcccctcagagtgactgaaggaaattcagagaagagctgacacctaagttgtagattttgcc

SEQ ID NO: 5258 - DNA, 201 bp, Homo sapiens
gcaggaagcagcatgatcagcagcattctctaggtgccaggttgagaacaggctgtgggggaacctgtaaagaggttgctgccatagttccggcgagtgayggtggtggcttggatggggtgatggcagtggagagggcaggagggaggatcaggaatggacctcaagacttcccagccctgggtctgctgcacttttcaa

SEQ ID NO: 5259 - DNA, 201 bp, Homo sapiens
tcgccggggagagttcatccaggaaattaggagacagctggaagcctgtcaaagagagagagcattttccgtgaagtttgaggtccaggctccacgctggsgcaacccccgtgcgctcagcttcgtactgagttcgctccagctcggggagggggtggagttcgatgtgctgcctgcctttgatgccctgggtgagagctc

SEQ ID NO: 5260 - DNA, 201 bp, Homo sapiens
gtgagcttggagcaaaagttcagtaagcaaaagaagaaagctgtctccactgtggagagggaagtctgagtggattgccagattgcagctgaatgcaaaamacttttataagaaaccactctcctccctgtaactgtttgagaaactttttatcagtaaagctgtgcaacttcccttaccttatgcagctgtgggtatatc

SEQ ID NO: 5261 - DNA, 201 bp, Homo sapiens
atgccattattttgttcctttttatggttgagtagtattccatggtgtgtttgtgtgtgtataacatttttctttatccactcattgattgatgggcattygggctggttccatatttttgcaattgcaaattgtgctgttataaacatgtgtgtgcaagtatcttttttgtataatgacttcttttcctctgggtagata

SEQ ID NO: 5262 - DNA, 201 bp, Homo sapiens
gtaaaggacaatgggaaaagaacacagatcctggaagaaggcccccaggtttgaattgtatttgccacctactagctgggtgatggggctgatatattatmtcactgagcatccattttcccatctgtaaaatgggaactaatgataatggcatccaaatcatagcatcattgtgagcattataggagtttaagacatgca

SEQ ID NO: 5263 - DNA, 201 bp, Homo sapiens
acacatttcaacacagcccagggatttcggacggtcttggaattagtcataaactaccagcaactctgcatctactggacaaagtattatgactttaaaamccccattattgaaaagtacctgagaaggcagctcacgaaacccaggtatgctatccccacatggcttagctcccctatgtaaatgaacacctggatacag

SEQ ID NO: 5264 - DNA, 201 bp, Homo sapiens
aagtgtttttctttttttttcttttttttttttttttttttttttttgagacagagtcttgcttgtcccccaggctggagtgcagtggcatgatctcggcycactgcaacctccgcctcccggtttcacgccattctcctgccccagcctcccaagtagctgggactacaggctccggccaccgcatccggctaatttttt

SEQ ID NO: 5265 - DNA, 201 bp, Homo sapiens
gactgacacatggtaggtgctccgttaatgttaccttttaaaaagattgctggggagagaccaggaccaaaagtgtttttctttttttttctttttttttyttttttttttttttttgagacagagtcttgcttgtcccccaggctggagtgcagtggcatgatctcggctcactgcaacctccgcctcccggtttcacgc

SEQ ID NO: 5266 - DNA, 201 bp, Homo sapiens
tagcataatgactgacacatggtaggtgctccgttaatgttaccttttaaaaagattgctggggagagaccaggaccaaaagtgtttttctttttttttcytttttttttttttttttttttttttgagacagagtcttgcttgtcccccaggctggagtgcagtggcatgatctcggctcactgcaacctccgcctcccg

SEQ ID NO: 5267 - DNA, 201 bp, Homo sapiens
gcataactgtgggagcgtgagcttagccctctgtgtttgtagaagcagaaacaaacctggaagattttggattattaacattatactttcttgcttcaatstcagagtcaggaggtcaggtgttgaccttccccctgccctccaagaggtgtgtgacactggggaagtcacttcccctctctgagcctcagggtttttcac

SEQ ID NO: 5268 - DNA, 201 bp, Homo sapiens
gggtctcagtatatgaatttggagggcacacaactcagtctatagcactgatgcctccatcaaaaataccccatgtgacagctggttgaggaggattaacmtcgaaccaccttattctcaatgccatttaggctgtagcacactttcttccaatcttatgctttttgtttccaagtagaaaagaaacgctttactgaagag

SEQ ID NO: 5269 - DNA, 201 bp, Homo sapiens
agacaccagtcctgtaggattagggccctacccttacgactctctttaaattaatgacttccttaaaggctcaatctccaaatatagttactggggtttarggtctcagtatatgaatttggagggcacacaactcagtctatagcactgatgcctccatcaaaaataccccatgtgacagctggttgaggaggattaaca

SEQ ID NO: 5270 - DNA, 201 bp, Homo sapiens
caactgatgtattttctcacagttctggaggcaaaaagtccaaggtgaaggtgccagcagggttgatgtctggggagggctctgctcctggcttacagagkctgcctcagggctgtgtcctcacatggccttcccagtgtggggggtgtatgtgtgtgtgtgtgtgtgtgtgtgtgtgagtgtgagagagagagagagaga

SEQ ID NO: 5271 - DNA, 201 bp, Homo sapiens
ttccctggtgaatcactcttctcaggatgccttagtaaaacgccacaggctgggtggctccaacaactgatgtattttctcacagttctggaggcaaaaaktccaaggtgaaggtgccagcagggttgatgtctggggagggctctgctcctggcttacagaggctgcctcagggctgtgtcctcacatggccttcccagt

SEQ ID NO: 5272 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttggtaagttaggggtggtctgaccttccccatctccccatcctcacagcag

SEQ ID NO: 5273 - DNA, 201 bp, Homo sapiens
tcaggaggtcaggtgttgaccttccccctgccctccaagaggtgtgtgacactggggaagtcacttcccctctctgagcctcagggtttttcacctgccakagggggttaggatgccctaccctgctgacccccagcaggctgctgaccccatctggggtgaggtgggaggcggggcagtgcgagtcaggggaaagttgac

SEQ ID NO: 5274 - DNA, 201 bp, Homo sapiens
tctctccaatgctaatagtagttcaatcagatgggcatgtggttaaagcctgagaatgaacagcaggtcaaaggtggggaaccaagtagcatgatgccatscaaagacccagagagacgtttcaggggcagagccaggggtcaggatggggcaggggtgggcctgggttggaggagcagcaggaaggctcgggcaccaagg

SEQ ID NO: 5275 - DNA, 201 bp, Homo sapiens
gtcgctgaacatctgtttcagttttcttatctgaaaatggaaatacaaatggtacccacttaataggctcttggaagaggactgtgagttattatttatamcatcttagagcaattagtggtgcaaagtcgagtccacaaatgttcacccctatttctcattgactgttattatacctataagtgccttgactaacactgt

SEQ ID NO: 5276 - DNA, 201 bp, Homo sapiens
ggctgctggcaccatggactcaggtaggcttgcttcttcctcttccctggctggttcctactcgcacctagaatggagggtggcgtttccacaactcagtsagccccagaggaacccggatggtcaagcaggccgatgagtcttccctgagccccaaaagaggccacatggagtcccccgacccaagggtctgtgggggca

SEQ ID NO: 5277 - DNA, 201 bp, Homo sapiens
agacacttgggcatagagtgcaagacacagatttggaatgaggagtcatttacagtaagcatgtatgcatgagtcaatatttttatatatttaagggagtrgagcccagtcatggaagacatgggatttgaatcagaagtcctggctctacccctattgtgaaaacatggcaaggttgcttaacatttgaggtttcttctg

SEQ ID NO: 5278 - DNA, 201 bp, Homo sapiens
ggtataaaccaaaagtaagattctaagcctccccctcatttaaaggacttcctcctcagccagggctcttaaaatttaacctgaaagactggttcaggccrtgaagggaaatgggggtcagacatgcttcattatgcctctctggcattaatatcaacacaggctttcagtctaataagaaacattttacagcctgtttct

SEQ ID NO: 5279 - DNA, 201 bp, Homo sapiens
cagtctaataagaaacattttacagcctgtttctctgtgaagcctgctagctgaaagcttcatctgcaggataaaactttggtctccacaacctcttatcrcaactcaaacattccttcctattgatctccggtctttagacaaactcaaccaattgtcaaccagaaaacgtttcaatttacctgtagcctggaaacgccc

SEQ ID NO: 5280 - DNA, 201 bp, Homo sapiens
gccaacccctacctttgaggggcctgacagggccacctcacagctgcctgggcttgttgttgcctcctcactacagaaaccatggaagtctctagagtcartgtttccaggctggggctgccagatcactcctgtaggtggttgaaccagttgagttcattcttctcagtgagggggacacaggtggaggtccatcggcac

SEQ ID NO: 5281 - DNA, 201 bp, Homo sapiens
cccagttaaggggttgaacttgaccctggcaggtcattaaagattcctcaggagacctaggtattgtggctcagggctgtaattcccgtgctaatgcacgraggctaatgcaggaggatccctcgaacccaggagttcaggacaagcctgggcagcatagcacgaccccatctctgcaaaaatgaaaataaaaagattgac

SEQ ID NO: 5282 - DNA, 201 bp, Homo sapiens
ctctgtgtcgtggcctcgaagggtctttgattctgtgcagcttcttttcctcctcatttctttaagggaggcatcgcattcattagtcttttttttctgayggagtcttgctctgtcgcccaggctggagtgcaagtagcaccatcggctcactgcaccctccgcctcctgggttcaagtgattctccagctcaccctcct

SEQ ID NO: 5283 - DNA, 201 bp, Homo sapiens
ccctccaagaggtgtgtgacactggggaagtcacttcccctctctgagcctcagggtttttcacctgccagagggggttaggatgccctaccctgctgacycccagcaggctgctgaccccatctggggtgaggtgggaggcggggcagtgcgagtcaggggaaagttgacattgcagcccagatgcctgcaggggctgca

SEQ ID NO: 5284 - DNA, 201 bp, Homo sapiens
gtcaggaggtcaggtgttgaccttccccctgccctccaagaggtgtgtgacactggggaagtcacttcccctctctgagcctcagggtttttcacctgccwgagggggttaggatgccctaccctgctgacccccagcaggctgctgaccccatctggggtgaggtgggaggcggggcagtgcgagtcaggggaaagttga

SEQ ID NO: 5285 - DNA, 201 bp, Homo sapiens
tccacaaagcaccatggcacttccctggtgaatcactcttctcaggatgccttagtaaaacgccacaggctgggtggctccaacaactgatgtattttctyacagttctggaggcaaaaagtccaaggtgaaggtgccagcagggttgatgtctggggagggctctgctcctggcttacagaggctgcctcagggctgtgt

SEQ ID NO: 5286 - DNA, 201 bp, Homo sapiens; identical to SEQ ID NO: 1432

SEQ ID NO: 5287 - DNA, 201 bp, Homo sapiens
gatcactggaatatttcccgtacatggggagaaagcatggtggaaagctcactttctggtgattctcagctgaaatagatcggttcctccacaaagcaccrtggcacttccctggtgaatcactcttctcaggatgccttagtaaaacgccacaggctgggtggctccaacaactgatgtattttctcacagttctggagg

SEQ ID NO: 5288 - DNA, 201 bp, Homo sapiens
ccaaccaccttgggcacatgtcatcaggacttcctgaggctgtgtcacaggcatacgtcctcaaccttggcaaaataaactttctaaattaactgacaccwgtctcagattttccgggttcacagcggttgggactgaccagtgggcatccctttgaacactgctctgaacatctttggaagcgtccttgctttctggggt

SEQ ID NO: 5289 - DNA, 201 bp, Homo sapiens
ggcacatggcagaaggaagcgatcactggaatatttcccgtacatggggagaaagcatggtggaaagctcactttctggtgattctcagctgaaatagatyggttcctccacaaagcaccatggcacttccctggtgaatcactcttctcaggatgccttagtaaaacgccacaggctgggtggctccaacaactgatgta

SEQ ID NO: 5290 - DNA, 201 bp, Homo sapiens
taattgatgtctcatgctccctaagtgtataaaatcaagctacaccccaaccaccttgggcacatgtcatcaggacttcctgaggctgtgtcacaggcatrcgtcctcaaccttggcaaaataaactttctaaattaactgacaccagtctcagattttccgggttcacagcggttgggactgaccagtgggcatcccttt

SEQ ID NO: 5291 - DNA, 201 bp, Homo sapiens
tcgaaactcagattttgaagacactggtgtaaagcgtttgacaataggcacatggcagaaggaagcgatcactggaatatttcccgtacatggggagaaarcatggtggaaagctcactttctggtgattctcagctgaaatagatcggttcctccacaaagcaccatggcacttccctggtgaatcactcttctcaggat

SEQ ID NO: 5292 - DNA, 201 bp, Homo sapiens
gtcaaccagaaaacgtttcaatttacctgtagcctggaaacgcccactttgagttgtcccgcctttctagaccaaaccgatgtatttctcaagtgtacttrattgatgtctcatgctccctaagtgtataaaatcaagctacaccccaaccaccttgggcacatgtcatcaggacttcctgaggctgtgtcacaggcatac

SEQ ID NO: 5293 - DNA, 201 bp, Homo sapiens
gaagcctgctagctgaaagcttcatctgcaggataaaactttggtctccacaacctcttatcgcaactcaaacattccttcctattgatctccggtctttrgacaaactcaaccaattgtcaaccagaaaacgtttcaatttacctgtagcctggaaacgcccactttgagttgtcccgcctttctagaccaaaccgatgt

SEQ ID NO: 5294 - DNA, 201 bp, Homo sapiens
tgctcttgacaaaatgaactattttcataacccactgatgggtcgaaactcagattttgaagacactggtgtaaagcgtttgacaataggcacatggcagraggaagcgatcactggaatatttcccgtacatggggagaaagcatggtggaaagctcactttctggtgattctcagctgaaatagatcggttcctccaca

SEQ ID NO: 5295 - DNA, 201 bp, Homo sapiens
agaaacgctttactgaagaggccaccaaatacttccgggagagagtcagcccagtgcatctgcaaatcctgctgactaacaatgaagcctggaagagattygtgactgcggctgaattgcccaggtaacctccgtggggttacctccatggggcgccccggctatgccatcctgatctcccctgggctagttttctctggc

SEQ ID NO: 5296 - DNA, 201 bp, Homo sapiens
cctaaacacatctagatcccaggaatttacataagggtatatatatatacacccttatgtatatatatattatatatatttcaaatatcttacaaaagaawactcactcttgctgtgttcaatacactctgatattttcaatgctcttttctttttaaaatgctgctcttgacaaaatgaactattttcataacccactga

SEQ ID NO: 5297 - DNA, 201 bp, Homo sapiens; identical to SEQ ID NO: 1436

SEQ ID NO: 5298 - DNA, 201 bp, Homo sapiens
tttgtagcgttgaccagtgtgggagtggtcagtgatacagcatatgcaccctgtgtcatattgacacagattgaaaatgctgccatcctaaacacatctakatcccaggaatttacataagggtatatatatatacacccttatgtatatatatattatatatatttcaaatatcttacaaaagaatactcactcttgctg

SEQ ID NO: 5299 - DNA, 201 bp, Homo sapiens
ttgtggctcagggctgtaattcccgtgctaatgcacggaggctaatgcaggaggatccctcgaacccaggagttcaggacaagcctgggcagcatagcacraccccatctctgcaaaaatgaaaataaaaagattgactgacatagtgatgcacttgtagttcccactactcagaaggatgaggcaggaggatcgattgat

SEQ ID NO: 5300 - DNA, 201 bp, Homo sapiens
atgtcccagtgcatacataaatccatactgcttcccagtcccttctctgcagttccataattcccaaatccctgcaaaccacacatttttggggcaactcmtctgggcagtaatcctgctgtgtactaagatgctttgtactgataatattatgtatcccatttaaggtgaatattcattggtttctctgttgaaacattt

SEQ ID NO: 5301 - DNA, 201 bp, Homo sapiens
gcaccacagccttggggaagtggaaacagcagggtcggggagtagggggagagcagggtccaggaggtgcggagggctgagagaggaggttgaccagcagycccgacctctgacctcccgctctgctcccagctgaccctggggtgtttccagcacaggccagtcccctccctccagctcttgccctgcaccagcccctct

SEQ ID NO: 5302 - DNA, 201 bp, Homo sapiens
gggagccacggttgcacccatctcctggcctgtgtgtgatcatcgaatgaggcacatatgaggagccctgcagatcacagacacccagtacacactggctrttatcaattagttatcacacatgttgccaggcccaggtcattgtcagaacgttccttcccatctctatttcggtgtatagactctgtagtttctgtgatt

SEQ ID NO: 5303 - DNA, 201 bp, Homo sapiens
tcaccatgttagccaggatgttctcgatctcctgaccttgtgatccacccacctccgccacccaaagtgctgggattacaggcatgagccaccgtgccagrcgcattccttagtcttaatgggcatagtgttagggacccgcctactccctatggcaggagatttagtgatttctccctttttggtgatagaaacaacgct

SEQ ID NO: 5304 - DNA, 201 bp, Homo sapiens; identical to SEQ ID NO: 1433

SEQ ID NO: 5305 - DNA, 201 bp, Homo sapiens; identical to SEQ ID NO: 1434

SEQ ID NO: 5306 - DNA, 201 bp, Homo sapiens
gagaacatgccaggcaaggtgatctcttccagtctgaggttttatttgatagcttaaggactcagagttagtcaaaatgcaatgtctgaaggcacccttcyttctgacaccagttgcagatttgaaggtgtttcttaagcccccactcaggtttgataattcactacaaagacttacgtaactcactgataactgttattg

SEQ ID NO: 5307 - DNA, 201 bp, Homo sapiens
gataacaggcatgcaccaccatgcccggctaattttttcatttttttagtagagacagagttgctccatgttggtcaggctgctctcgaactcccaacctsaggtgatccacccacctcagcttcctaaagtgctgggattacagatgtgaaccagtgtgcctagccagcttttctttagggagtaaatcattttctttac

SEQ ID NO: 5308 - DNA, 201 bp, Homo sapiens
catgggatttgaatcagaagtcctggctctacccctattgtgaaaacatggcaaggttgcttaacatttgaggtttcttctgtttcaaaatgggagccacrgttgcacccatctcctggcctgtgtgtgatcatcgaatgaggcacatatgaggagccctgcagatcacagacacccagtacacactggctgttatcaatt

SEQ ID NO: 5309 - DNA, 201 bp, Homo sapiens
attatactgactggtaacaagtagatttagttctcatatgtaaatgttctgttttgttctaaaagttaaaagttaaccaagtgtttacattttggtgacgytttaaatcttgcttactgttgagctgagttgtacaatatggttgcacatgttttgctgcacggctttagtttttcctgatgtttctaattgcctttgttt

SEQ ID NO: 5310 - DNA, 201 bp, Homo sapiens
agtgtatacggttcagacaaatcatttaataaagagggctccactcactcccttcccaattaaaagcagctaattttgatgttcagattttcctttttttwttttctgagacagaatttcactcttgttgcccaggctggagtgcaatgtagctatcttggctcaccacaaactccacctcctgggttcaagcgattctcc

SEQ ID NO: 5311 - DNA, 201 bp, Homo sapiens
ggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttctt

SEQ ID NO: 5312 - DNA, 201 bp, Homo sapiens
aggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttct

SEQ ID NO: 5313 - DNA, 201 bp, Homo sapiens
acttcttcagtgatccagccagcatttgccctgacacttagagttgaaatgccatcaggctacctgcatttgatgcaattccactgtactgctagtattgyttaaaaatttttcaattgcaagcaacagaaacagaaactatctgtcttaaacaaaatagaagattcattggatgaaaactagagcaggtcagaggatgga

SEQ ID NO: 5314 - DNA, 201 bp, Homo sapiens
agaggttgtttcacccaccctgactctgagcacctacttgagccaggccctgtgggtaaactgaggccatgggagatgagtgactcgctgagggtcccatrtcaggaagttgagcaggtagatcacaggactccatgtccctgacactcacctggttccttttcaggcctctgggtgatagagaagaaagaagctgtgctg

SEQ ID NO: 5315 - DNA, 201 bp, Homo sapiens; identical to SEQ ID NO: 1439

SEQ ID NO: 5316 - DNA, 201 bp, Homo sapiens
cataataatcacaatcaattattactgttgaatataagcggtataaaccaaaagtaagattctaagcctccccctcatttaaaggacttcctcctcagccrgggctcttaaaatttaacctgaaagactggttcaggccatgaagggaaatgggggtcagacatgcttcattatgcctctctggcattaatatcaacacag

SEQ ID NO: 5317 - DNA, 201 bp, Homo sapiens
ttggaccaagtaaacatgatcataataatcacaatcaattattactgttgaatataagcggtataaaccaaaagtaagattctaagcctccccctcatttmaaggacttcctcctcagccagggctcttaaaatttaacctgaaagactggttcaggccatgaagggaaatgggggtcagacatgcttcattatgcctctc

SEQ ID NO: 5318 - DNA, 201 bp, Homo sapiens
caaatgttctcacttgaatgttagtatcaacccaaggcctttcacagattcatcttggaccaagtaaacatgatcataataatcacaatcaattattactrttgaatataagcggtataaaccaaaagtaagattctaagcctccccctcatttaaaggacttcctcctcagccagggctcttaaaatttaacctgaaaga

SEQ ID NO: 5319 - DNA, 201 bp, Homo sapiens; identical to SEQ ID NO: 1441

SEQ ID NO: 5320 - DNA, 201 bp, Homo sapiens
caatagacacctggatgcaagatccctaagacagaggcaggaaataggaagagggaggtgagaggctttcgatgaggatgcttctacacatgaccttgagratgaaaacgcatcagggggtcccgggaaccactgcgttgttaacataaagtctgggagcaaagaccagcggctggaatggatgtgcctgggagccagctg

SEQ ID NO: 5321 - DNA, 201 bp, Homo sapiens
aagatgaggagagggcagggaagattagaagccgggacctaccagccaaccccggaatccttcagaagggcttggctgggaggctcaaggaagaaactctstctccgaaacaagatgatctgtggtttaataacgcggccagctgggttcagaggtgatagtggggagccatgtcccctgagaccagcctgcagaggacag

SEQ ID NO: 5322 - DNA, 201 bp, Homo sapiens
gtttttctttttttttcttttttttttttttttttttttttttgagacagagtcttgcttgtcccccaggctggagtgcagtggcatgatctcggctcacygcaacctccgcctcccggtttcacgccattctcctgccccagcctcccaagtagctgggactacaggctccggccaccgcatccggctaattttttttgt

SEQ ID NO: 5323 - DNA, 201 bp, Homo sapiens
acaggtggctcacattcagtcccacaatttgctttctcctcctcaagggttaagaaaaaaaacgaacccttccagtcaggtcagtgactggagagctccawggaaagtctctcagtgacctggctgctggcaccatggactcaggtaggcttgcttcttcctcttccctggctggttcctactcgcacctagaatggaggg

SEQ ID NO: 5324 - DNA, 201 bp, Homo sapiens
gggggacaaagggtgtccagcacagcaccagtgaattcaccaagacagacacttgggcatagagtgcaagacacagatttggaatgaggagtcatttacartaagcatgtatgcatgagtcaatatttttatatatttaagggagtggagcccagtcatggaagacatgggatttgaatcagaagtcctggctctacccct

SEQ ID NO: 5325 - DNA, 201 bp, Homo sapiens
ggacaaaacacatggggtgttgccaaccagagaagctcacccagttaaggaaaaattcctgtgaatcacattagatcaggaagcctttattcaggattgttgttacaggggagggagactgagcccagctcccaatatagtaaagacagagggggagtcacagccaacaccagggtgaggagtgggagatggaccagttct

SEQ ID NO: 5326 - DNA, 201 bp, Homo sapiens
cttggctctgtccctgcacagctctggggctgttgttttatgtcttggagactgggacctgccatctctccaatgctaatagtagttcaatcagatgggcrtgtggttaaagcctgagaatgaacagcaggtcaaaggtggggaaccaagtagcatgatgccatccaaagacccagagagacgtttcaggggcagagccag

SEQ ID NO: 5327 - DNA, 201 bp, Homo sapiens
ggtatgcacacaggtgaagctgtcacctgctaaggcattagtttggctggcgacatgtgacagtgagaccctgaagcttggaggtgccaggtcaggaggcmgtcaagtggcttgagagttcatgtgcagccaggactaatagccaggcctttcacttttcagtcaaagggggcagtggctggacccagtggccttcagtca

SEQ ID NO: 5328 - DNA, 201 bp, Homo sapiens
tcaaagtctcatgagtccataagaggttccatgaaattgcacatggcattggtatgcacacaggtgaagctgtcacctgctaaggcattagtttggctggygacatgtgacagtgagaccctgaagcttggaggtgccaggtcaggaggcagtcaagtggcttgagagttcatgtgcagccaggactaatagccaggcctt

SEQ ID NO: 5329 - DNA, 201 bp, Homo sapiens
tgtccaaatgcaggtcttttcagcattagtgatttatagagatgattttcaaagtctcatgagtccataagaggttccatgaaattgcacatggcattggyatgcacacaggtgaagctgtcacctgctaaggcattagtttggctggcgacatgtgacagtgagaccctgaagcttggaggtgccaggtcaggaggcagt

SEQ ID NO: 5330 - DNA, 201 bp, Homo sapiens
gagagggatatttcttccctccctgatttgatcccatcactgatgggcatagtgggccatgggtgactgtttccctgacagcatgcctgggaactggggcrttctgaactgccatttgggaccctcttctgttctacatagagtagaggaagtgtttcttcgggccagcttggagagttggaacaagtgtctgccaactgg

SEQ ID NO: 5331 - DNA, 201 bp, Homo sapiens
ggatggggcaggggtgggcctgggttggaggagcagcaggaaggctcgggcaccaaggctgggagtagggtgagaagagggaggcactgagggcatgaaakgtaacgtggccatggacttgcagaggaccagtgagtgggagagggatatttcttccctccctgatttgatcccatcactgatgggcatagtgggccatgg

SEQ ID NO: 5332 - DNA, 201 bp, Homo sapiens
gttttatgtcttggagactgggacctgccatctctccaatgctaatagtagttcaatcagatgggcatgtggttaaagcctgagaatgaacagcaggtcaraggtggggaaccaagtagcatgatgccatccaaagacccagagagacgtttcaggggcagagccaggggtcaggatggggcaggggtgggcctgggttgg

SEQ ID NO: 5333 - DNA, 201 bp, Homo sapiens
atcttgacctgatcaatgtgtgttcctggagatgctgtccggggcccttttcttccacctctgaggaactgcacaaacacagcaggatcctcctgctgacmcagaacacagagaggctggaatggagttggacagagctgggggtggatcttggctctgtccctgcacagctctggggctgttgttttatgtcttggagac

SEQ ID NO: 5334 - DNA, 201 bp, Homo sapiens
gaaaaaaaattgcaaaacgatcttcagaagctgtgctgctgcctatggcagtgtggcagggagggggcctcgggtggggtgagtgcccaaaagggtgggcraggacgatttggggagttctccaaaggttatgacccactatgggcctacccttcgttcccggctgtaaacctctaaacttagcatttatccaagctatcc

SEQ ID NO: 5335 - DNA, 201 bp, Homo sapiens
ttggctcagagctgaggcaggagggagggctccctgtctgggcctcctccaggaactaaagtccctttccgggaattgaccaaactgcaggcttgcccagrgaggacatgctgtgtcctagttcagctcgaggggcagtatccagcttcaaccctcagcggatgccccagacaagattccgagccaggccaacaacgccta

SEQ ID NO: 5336 - DNA, 201 bp, Homo sapiens; identical to SEQ ID NO: 1437

SEQ ID NO: 5337 - DNA, 201 bp, Homo sapiens
ggcctgggccattgccgtgggggaggggaggcttggaaaccatggctatgattcagaggttagctggctcgcgtgtttttagaaatttcttttttctttcycctcgtacaaaagtaataagactggggaggacacgggagaaaataaatggaaactcagaaacctgatagagccaccaaaagtacatgaaatcagagtcat

SEQ ID NO: 5338 - DNA, 201 bp, Homo sapiens
agcaataaatacacagatctagtgctggaggttccctccatccaaccctggtttccttcatcctttcagtgaaggaggaaaaaataaaagcaaaatacccstcacccaagtcagcactgtgttcatttccctaaggcctgttttctcccctcactgagttgccttggcaaccaagtcacatctgctcaggagccgccctgg

SEQ ID NO: 5339 - DNA, 201 bp, Homo sapiens
ctggccgaagttaagttttgtttgtgcctaacgtaagcacccatctgaaacgactccagttaagttccccatagttggcagtttaaggggggttacagccwttctgaaggcctgtttgcttttgtttgcccaggtgttcattttaagtttgctttaacaccctggtactcccaccccagcaataaatacacagatctagtg

SEQ ID NO: 5340 - DNA, 201 bp, Homo sapiens
cctccctccagctcttgccctgcaccagcccctctgctctgagtggccctgtgaaaagagtgactcagcgtcccactgaactgagccccattctggccttygccacgtcttctctgtgtcacctggagcttcttacctcccctcacctggaatgcgagtataatatttccccatgtggtcatgaggatcaaatagtacatg

SEQ ID NO: 5341 - DNA, 201 bp, Homo sapiens
cccccgacccaagggtctgtgggggcatctatgtcctgacctctcctcaggggagcatggcccaggtgcccacttcctccctgccctggcacctagcaaaygactcaagtggggcaccacagccttggggaagtggaaacagcagggtcggggagtagggggagagcagggtccaggaggtgcggagggctgagagaggag

SEQ ID NO: 5342 - DNA, 201 bp, Homo sapiens
gggtttcatcgtgttagccaggatggtcttgatctcctgacctcgtgatcctcccgcctcggcctcccaaggtgctgggattacaggcatgagccgctgcrcccgaccaagtgtttttcttagagttggatgcccagcaggactttctttgaaaaaagccagaaaaatcttgacctgatcaatgtgtgttcctggagatgc

SEQ ID NO: 5343 - DNA, 201 bp, Homo sapiens
ctcggctcactgcaacctccgcctcccggtttcacgccattctcctgccccagcctcccaagtagctgggactacaggctccggccaccgcatccggctawttttttttgtatttttagtacagacggggtttcatcgtgttagccaggatggtcttgatctcctgacctcgtgatcctcccgcctcggcctcccaaggtg

SEQ ID NO: 5344 - DNA, 201 bp, Homo sapiens
ccctctcatttcacccagactcctgcaaaagcttccagaatggtcttccctgttatacagcccttgccactatccctgcccatcctccacactgggccaakttgccccgtaagaacatagatttcttcaagcccatgcttccatgtcttcaatggcttcctattactcttagcacaaaagcccagagccttcatgctgtct

SEQ ID NO: 5345 - DNA, 201 bp, Homo sapiens
tgtttttctttttttttcttttttttttttttttttttttttttgagacagagtcttgcttgtcccccaggctggagtgcagtggcatgatctcggctcaytgcaacctccgcctcccggtttcacgccattctcctgccccagcctcccaagtagctgggactacaggctccggccaccgcatccggctaattttttttg

SEQ ID NO: 5346 - DNA, 201 bp, Homo sapiens
cacttggcatctccccagataggaaagggaggactcacttgaatgaaacgacttctcttgtgaactatcaaggggccgccagaatcacctgcaaggagagsagaagctgtagagaaaaggactgttgggccttgggcacttgtagcacaaccaaagagcattctctcacctctgcaagtattggggtcagcatagggactc

SEQ ID NO: 5347 - DNA, 201 bp, Homo sapiens
aggtggaagcttacacatctccctcagcctctggtttttcagcacttgggattggggttaaacctttaaaaacggctgtcaggtttgatctcagtgtaacracatggccagtgcctgttccccactcccttgccccaaaaggatctggaacacaggtgttgtcgcagctgttttaattcaatcccacgcccctgtccagca

SEQ ID NO: 5348 - DNA, 201 bp, Homo sapiens
tctggccatatttcagcttattcttgagcttgatcagggcaacgtcatagtcataaaattcaggaattcctgcttcttttttcccattaatgttgtagttrgggtgaaataggactacttctatctccaggtcccgcttctcccctcctgaagtaggagagtaggtaccacctctttgtgggcagcttcctgcctctggcc

SEQ ID NO: 5349 - DNA, 201 bp, Homo sapiens
ctgtcttcaaacctgggccgtgcccatcctcagcatcgactccttctatggtctctgtcagggaagacaggaaagcttcggccacctcttgaggggtgtcrtacatgaaggagtctgggagagtcagaaatgaggtcaaatgtctgggagtgtcagggatacagtgaccaaagagacgggggatcatgggtttccagggta

SEQ ID NO: 5350 - DNA, 201 bp, Homo sapiens
cctggggccgccttggttaccgcgttttccgctcctcgctacgtcatcgttgtgagcccgctatcagcggccagcgcgggcgcggccggagaccgtggggmccccggttgccgccccctcgggtaaggccctctgcttctcactcttcggccctttttctcatagccgtttctctgttcttcctctttgcgttgctctgcg

SEQ ID NO: 5351 - DNA, 201 bp, Homo sapiens
tgcctcatatgccccaatgctggtctcagtaaaacactgaggtggaagcttacacatctccctcagcctctggtttttcagcacttgggattggggttaarcctttaaaaacggctgtcaggtttgatctcagtgtaacaacatggccagtgcctgttccccactcccttgccccaaaaggatctggaacacaggtgttgt

SEQ ID NO: 5352 - DNA, 201 bp, Homo sapiens
ccaggagagtggctcaggctccagcattaacagttctgtcccttctccattttcccccagttccctgccctgcctcccttctctgtcttcaaacctgggcygtgcccatcctcagcatcgactccttctatggtctctgtcagggaagacaggaaagcttcggccacctcttgaggggtgtcgtacatgaaggagtctggg

SEQ ID NO: 5353 - DNA, 201 bp, Homo sapiens
catgggctatgtcttgtgactatgatttgtgctcccaaagggtcggattcattccctgaacggcgagcccctaggaaagggaatactctctatgtatatgkagaagacatgacacccacccttctccgtggggccttctctccttttggaaacatcattgacctctccatggacccacccagaaagtaaggatgacaacag

SEQ ID NO: 5354 - DNA, 201 bp, Homo sapiens
acaggccatcctggccaccagagggcagcgtggaaactgggcttccaggggccagtggccaggagtgaggtggtcaggagtcagcctcagggtctgttctrtgatctcctttagaccttaactgttcctctcctccctccctagctgtccagaacagccctaagggttgccaccgggacaagaggacccagattgtctaca

SEQ ID NO: 5355 - DNA, 201 bp, Homo sapiens
gaccgtggggcccccggttgccgccccctcgggtaaggccctctgcttctcactcttcggccctttttctcatagccgtttctctgttcttcctctttgcrttgctctgcgggcgctacgctggctccaccgccttctctgccgttcaaaccccgcggttgtccttaccctagcgagggtaggggggtcgggtgccatcgt

SEQ ID NO: 5356 - DNA, 201 bp, Homo sapiens
tggaccggtggaaggccgggcggaagtgcgcgcctggggccgccttggttaccgcgttttccgctcctcgctacgtcatcgttgtgagcccgctatcagcrgccagcgcgggcgcggccggagaccgtggggcccccggttgccgccccctcgggtaaggccctctgcttctcactcttcggccctttttctcatagccgt

SEQ ID NO: 5357 - DNA, 201 bp, Homo sapiens
agctcaagggtggtggggatggaaccattggatggggtgaagagagtaacatgtctggtggagggaggaaagaggaaggggaagaaacagctagaggcttragagagaatggtgagggccaaagctacaccctgaatgagttctggtggagctagtagcatttcttagtgtgaataatccattttccctgaaagtagattt

SEQ ID NO: 5358 - DNA, 201 bp, Homo sapiens
agaccgagagggtcctttccgcagtgagtgattttggctggaggtcaaggtgaccttaactgaggtttatgtgggtcctactaagtgaaatgtggcatggkctatgtcttgtgactatgatttgtgctcccaaagggtcggattcattccctgaacggcgagcccctaggaaagggaatactctctatgtatatggagaag

SEQ ID NO: 5359 - DNA, 201 bp, Homo sapiens
tttggttagattaggaatttccagcatcatacatgatctaggggaccagaggcaagaggcagagcacatcagtgtaccactctgagggcatcaagaaagayggtccctggagtgatgtgcccaggggccttaggagaggaaccggctaggggctggccctcacttacctctctcttctcacccttgttcccagaaaaaggc

SEQ ID NO: 5360 - DNA, 201 bp, Homo sapiens
ttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctctgg

SEQ ID NO: 5361 - DNA, 201 bp, Homo sapiens
cttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctctg

SEQ ID NO: 5362 - DNA, 201 bp, Homo sapiens
gcttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctct

SEQ ID NO: 5363 - DNA, 201 bp, Homo sapiens
tgcttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctc

SEQ ID NO: 5364 - DNA, 201 bp, Homo sapiens
agggaagaaaagatcagaggaaacctagaagagggtgagggaagaggaacacctctggtccatggttgggcaacctcctgctccacactgaggtaggtctytcaccactccaggaccccgagaagggaccagtccccactttccagccgttccagaggagcatatctgctgatgatgacctgcaagaggtaaaggctccta

SEQ ID NO: 5365 - DNA, 201 bp, Homo sapiens
attacttcaggggaacctgaggagagttgtgttctttattcccttgtatctccctaccgatcatttggtagaaaacatcttccaggttttccatatccttractttgaacacatgttgctcattgtctttcttggaagccaaagcattgatgttcacttggttcaccaaaggcccgaccccaaacacatagacatctgagg

SEQ ID NO: 5366 - DNA, 201 bp, Homo sapiens
tgaagaaggctttccaggcaactagagcttcaggtgtagaggaagaatgaattacttcaggggaacctgaggagagttgtgttctttattcccttgtatckccctaccgatcatttggtagaaaacatcttccaggttttccatatccttgactttgaacacatgttgctcattgtctttcttggaagccaaagcattgat

SEQ ID NO: 5367 - DNA, 201 bp, Homo sapiens
aggaaaccccttatagaaaacccaaatcctcatcttggagtttctccttcagccagggcagcacttgaaagaggttgatgtgaaagtctcgggcgtgagcrggtacctgcttttgccgcttctggtttttgcagacatccactactccccagctgattacaccaacctgcagaggcagtggggtgccatggatcattcagt

SEQ ID NO: 5368 - DNA, 201 bp, Homo sapiens
tgatcccgaccagcgggagcttggacagcagcctggtttaagcaaggggtagggaaagccaaagacaagagtaggcagacctgaaggggtggggttgggtrcagtgtggacggcgtgtgaaccccgggtggtaacagtggagaaagatgtcttgggccctgcccctgaactaggagccaccatgttggtgataccccccgg

SEQ ID NO: 5369 - DNA, 201 bp, Homo sapiens
ttcccttcctgctgtctccagcatccctccttggccttttggggccaggcttcatcagcctttctcttcaggtgtgaccaccactccatggtctttggccyggccccagggatcctgctctctggagggggtagagatcaaaggcggctccttccgacttctccaagagggccaggcactggagtacgtgtgtccttctgg

SEQ ID NO: 5370 - DNA, 201 bp, Homo sapiens
cccaatgctggtctcagtaaaacactgaggtggaagcttacacatctccctcagcctctggtttttcagcacttgggattggggttaaacctttaaaaacrgctgtcaggtttgatctcagtgtaacaacatggccagtgcctgttccccactcccttgccccaaaaggatctggaacacaggtgttgtcgcagctgtttt

SEQ ID NO: 5371 - DNA, 201 bp, Homo sapiens
tgggacaggagagaggtcccttctgaccatcagtcatgaggatgatgacatggcgggtgcggttccagccttcaggagggacgtcatctggccagctcatmatgctgtacactgcctggagggccttcttggtgttagtccctgacttcaacttgtggtctgtggagagggaagagaccatcacctcacctggtcttccaa

SEQ ID NO: 5372 - DNA, 201 bp, Homo sapiens
ggtctccctactacaatgtgagtgatgagatctctttccactgctatgacggttacactctccggggctctgccaatcgcacctgccaagtgaatggccgrtggagtgggcagacagcgatctgtgacaacggaggtgagaagcatcccctccccctacattgctgtctccctgacggcgcccagcccgaggagtgggcac

SEQ ID NO: 5373 - DNA, 201 bp, Homo sapiens
acagcagctgcctggcagcccggaagtgcggcaagtagtcgctgcgaagtaagccccgccccggaacgggcggaagtagaggcaacttccggtacagcccygccgagagcgtgaactatcgctgcggaggggcagacctggaccggtggaaggccgggcggaagtgcgcgcctggggccgccttggttaccgcgttttccg

SEQ ID NO: 5374 - DNA, 201 bp, Homo sapiens; identical to SEQ ID NO: 1473

SEQ ID NO: 5375 - DNA, 201 bp, Homo sapiens
ctgtacagctcaaagtcaacatagcccgaaaacagcccatgctggatgccgctactggcaagtctgtctggggctccctcggtaagaatgggattcttccyttcccatcctctcccccacaggccattccttttggttcccccacacatccttgggtttcctagagatgatcgaggtcagagtgtgtgcggaggctatggg

SEQ ID NO: 5376 - DNA, 201 bp, Homo sapiens
gttggaatgtagatgggtttggggaaaaatatgcatactcaagcactggcaaattgctgtaccattctgagtttcacctctcatgtataaaatgaaaaaaytagacgactcctgaattctccattttacaaattctgtggttctaatccaccttggattggagctcttggaatatgttgccctaagggatggaaagggctg

SEQ ID NO: 5377 - DNA, 201 bp, Homo sapiens
gggatctggacgctctcacctgatagtctggccatatttcagcttattcttgagcttgatcagggcaacgtcatagtcataaaattcaggaattcctgctkcttttttcccattaatgttgtagttggggtgaaataggactacttctatctccaggtcccgcttctcccctcctgaagtaggagagtaggtaccacctct

SEQ ID NO: 5378 - DNA, 201 bp, Homo sapiens
tcccttcctgctgtctccagcatccctccttggccttttggggccaggcttcatcagcctttctcttcaggtgtgaccaccactccatggtctttggcctrgccccagggatcctgctctctggagggggtagagatcaaaggcggctccttccgacttctccaagagggccaggcactggagtacgtgtgtccttctggc

SEQ ID NO: 5379 - DNA, 201 bp, Homo sapiens
ttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagaccag

SEQ ID NO: 5380 - DNA, 201 bp, Homo sapiens
cttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagacca

SEQ ID NO: 5381 - DNA, 201 bp, Homo sapiens
acttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagacc

SEQ ID NO: 5382 - DNA, 201 bp, Homo sapiens
cacttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagac

SEQ ID NO: 5383 - DNA, 201 bp, Homo sapiens
tcacttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgaga

SEQ ID NO: 5384 - DNA, 201 bp, Homo sapiens
aaagtcaacatagcccgaaaacagcccatgctggatgccgctactggcaagtctgtctggggctccctcggtaagaatgggattcttcctttcccatcctytcccccacaggccattccttttggttcccccacacatccttgggtttcctagagatgatcgaggtcagagtgtgtgcggaggctatgggaatgggaagga

SEQ ID NO: 5385 - DNA, 201 bp, Homo sapiens
gcagatcacttgagattaggagtttaagaccaacctggccaacatggtaaaaccccgtctctactaaaaatacaaaaatcagcagggtgtgaggccgggcrcggtggctcacacctgtaatcccagcactttgggaggccgaggcaggcggatcacgaggtcaggagatcgagaccatcctggctaacaaggtgaaacccc

SEQ ID NO: 5386 - DNA, 201 bp, Homo sapiens
accgcagccatgagaggaaccgggacagagaccgagatcgggagcgggatcgagaccgggatcgagacagagacagagagcgggacagggatcgggatcgrgatcgagatcgagaccgggaacgggacagggatcgggagcgggatcgagaccgagaccgagagggtcctttccgcagtgagtgattttggctggaggtca

SEQ ID NO: 5387 - DNA, 201 bp, Homo sapiens
actacaccaattctgccacatgtttggactcaaaactctgacttccccactatttgcatagtcaaacctttgccaagtcttattgtttcttcttttgaagkaatttttcctgtttattcttcactgtgcattcccccgagcagggctttattgacattcatgtgggccattgtaatggtctctcaacaaatttctcagtct

SEQ ID NO: 5388 - DNA, 201 bp, Homo sapiens
tctggacgctctcacctgatagtctggccatatttcagcttattcttgagcttgatcagggcaacgtcatagtcataaaattcaggaattcctgcttcttytttcccattaatgttgtagttggggtgaaataggactacttctatctccaggtcccgcttctcccctcctgaagtaggagagtaggtaccacctctttgt

SEQ ID NO: 5389 - DNA, 201 bp, Homo sapiens
cgacttctcttgtgaactatcaaggggccgccagaatcacctgcaaggagaggagaagctgtagagaaaaggactgttgggccttgggcacttgtagcacraccaaagagcattctctcacctctgcaagtattggggtcagcatagggactcactcctccagtacaaaggaaccgaggggtgaccacctctgagatgtcc

SEQ ID NO: 5390 - DNA, 201 bp, Homo sapiens
tcactgggagagagggaaggttagtgtgggggatgcacccatagagtgttctgcagcagttggaagcagtgggttagatgtggccacaggaacatggacaratgttgaaacactaggtggagaaaaagaagcaaaaaaaaatcagatatataaccactttttatatgaattataaactacaagctcacaaaagaagacatg

SEQ ID NO: 5391 - DNA, 201 bp, Homo sapiens; identical to SEQ ID NO: 1501

SEQ ID NO: 5392 - DNA, 201 bp, Homo sapiens
gtgggtggatcacaaggtcaagagatcgagaccatcctggccaacatggtgaaaccctgtctctactaaaaatacaaaaattagctgggcatggtggcagrtgcctgtagtcccagctacttgggaggctgaggcaggagaattgcttgaacccaggaggcagagattgcagtgagccaagatagcaccgctgcactccag

SEQ ID NO: 5393 - DNA, 201 bp, Homo sapiens
tttgcctggagagttcagtgagatcccataagtaacaactgggatggtgccttatgcctacaaagtaaggtgggcttggccagggctgggggtgtgtgtaygtagagcctttgctgatcctttctgttctcctctgtcccaggtcttgtttgccacagagacctttgccatgggagtaaacatgcctgctcgtacagtagt

SEQ ID NO: 5394 - DNA, 201 bp, Homo sapiens
acgatggcacccgacccccctaccctcgctagggtaaggacaaccgcggggtttgaacggcagagaaggcggtggagccagcgtagcgcccgcagagcaaygcaaagaggaagaacagagaaacggctatgagaaaaagggccgaagagtgagaagcagagggccttacccgagggggcggcaaccgggggccccacggtc

SEQ ID NO: 5395 - DNA, 201 bp, Homo sapiens
catggttgcagagctaggaccggatctgacgggagtaggcccagtccagaagactggctggggttcagtaggtcccaccctgatctcagtgacttctgtgrcctgactccaggggaagccgtcccagctgcagtcccagttccgcctcacgtacactatgatcctcaacttgctgcgagtggatgccctcagggtggagga

SEQ ID NO: 5396 - DNA, 201 bp, Homo sapiens
ctgttgtcatccttactttctgggtgggtccatggagaggtcaatgatgtttccaaaaggagagaaggccccacggagaagggtgggtgtcatgtcttctmcatatacatagagagtattccctttcctaggggctcgccgttcagggaatgaatccgaccctttgggagcacaaatcatagtcacaagacatagcccatg

SEQ ID NO: 5397 - DNA, 201 bp, Homo sapiens; identical to SEQ ID NO: 1504

SEQ ID NO: 5398 - DNA, 201 bp, Homo sapiens
attttccccacttggccagggcaggttgcgtcatcatagggccctcattttcccctcttgccctccttttcaccctctcccttcccatcaccacatcatgytcactccttcctcccaccaccccaagaagtctgctctgatcgcttgacttggttgcccctctctactggtgagctctgcatggttgcttcctgattcctg

SEQ ID NO: 5399 - DNA, 201 bp, Homo sapiens; identical to SEQ ID NO: 1506

SEQ ID NO: 5400 - DNA, 201 bp, Homo sapiens
aacagttggggagaaggggaggtggtcagagacaagctcagcctcattggggctctgatctcttgccttaggtcttgctggagaacacaaatctctcggcyacaacctccttgtctcttcgccggcctccagggccagcctcccagtccttatggggaaatccaactcagtatcccttctggccaggtgactcttgtggag

SEQ ID NO: 5401 - DNA, 201 bp, Homo sapiens; identical to SEQ ID NO: 1508

SEQ ID NO: 5402 - DNA, 201 bp, Homo sapiens
gcctttttctgggaacaagggtgagaagagagaggtaagtgagggccagcccctagccggttcctctcctaaggcccctgggcacatcactccagggaccrtctttcttgatgccctcagagtggtacactgatgtgctctgcctcttgcctctggtcccctagatcatgtatgatgctggaaattcctaatctaaccaaa

SEQ ID NO: 5403 - DNA, 201 bp, Homo sapiens
gtgggtggggcagtggttggggcaggggggctaggggacagcagtgtgtccaatgcccaccctttttcttgcaggtgctccgaaccctgggttacgtggaygaggcgggcactgtgaagctggcagggcgggtggcttgtgccatgagcagccatgagttgctcctcactgagctcatgtttgacaatgcactgagcaccc

SEQ ID NO: 5404 - DNA, 201 bp, Homo sapiens
tgtctcttcgccggcctccagggccagcctcccagtccttatggggaaatccaactcagtatcccttctggccaggtgactcttgtggagatgggatggtmgaagagggtgtctttaatctccagggaagggttccccacctatctcgtattaccctcatcccatgaatccctgtctgtcctgtctcttcccaggggggat

SEQ ID NO: 5405 - DNA, 201 bp, Homo sapiens
cggatctgacgggagtaggcccagtccagaagactggctggggttcagtaggtcccaccctgatctcagtgacttctgtgacctgactccaggggaagccrtcccagctgcagtcccagttccgcctcacgtacactatgatcctcaacttgctgcgagtggatgccctcagggtggaggacatgatgaagaggagcttct

SEQ ID NO: 5406 - DNA, 201 bp, Homo sapiens
ggtgggagggagcaagccctctctccattttccccacttggccagggcaggttgcgtcatcatagggccctcattttcccctcttgccctccttttcaccctctcccttcccatcaccacatcatgctcactccttcctcccaccaccccaagaagtctgctctgatcgcttgacttggttgcccctctctactggtgagc

SEQ ID NO: 5407 - DNA, 201 bp, Homo sapiens
cctgggagccccagtcccatccgacctacaggcccaaagacacccaaccacaggccagatactgggttacaaagaggtaggaggtcaggggtcatgagaamcagttggggagaaggggaggtggtcagagacaagctcagcctcattggggctctgatctcttgccttaggtcttgctggagaacacaaatctctcggcta

SEQ ID NO: 5408 - DNA, 201 bp, Homo sapiens
cttgtcccccaggggttttgacttgagctttgagcactgccccagttaacactagctcacctctcattggttcaggaactcaacctctgctccttcccctyccccttccttctccaggaccgcggagtgtacctgtccctcctggcctccctccgcacacgtgcccagttgcccgtggtggtgttcaccttctcccggggc

SEQ ID NO: 5409 - DNA, 201 bp, Homo sapiens
gtgggagggagcaagccctctctccattttccccacttggccagggcaggttgcgtcatcatagggccctcattttcccctcttgccctccttttcaccctctcccttcccatcaccacatcatgctcactccttcctcccaccaccccaagaagtctgctctgatcgcttgacttggttgcccctctctactggtgagct

SEQ ID NO: 5410 - DNA, 201 bp, Homo sapiens
gtagaggtgggtggggcagtggttggggcaggggggctaggggacagcagtgtgtccaatgcccaccctttttcttgcaggtgctccgaaccctgggttaygtggacgaggcgggcactgtgaagctggcagggcgggtggcttgtgccatgagcagccatgagttgctcctcactgagctcatgtttgacaatgcactga

SEQ ID NO: 5411 - DNA, 201 bp, Homo sapiens
ctgggagccccagtcccatccgacctacaggcccaaagacacccaaccacaggccagatactgggttacaaagaggtaggaggtcaggggtcatgagaaamagttggggagaaggggaggtggtcagagacaagctcagcctcattggggctctgatctcttgccttaggtcttgctggagaacacaaatctctcggctac

SEQ ID NO: 5412 - DNA, 201 bp, Homo sapiens
cctcttgccctccttttcaccctctcccttcccatcaccacatcatgctcactccttcctcccaccaccccaagaagtctgctctgatcgcttgacttggktgcccctctctactggtgagctctgcatggttgcttcctgattcctgcccaagggtgggtatctggtctctgcctttgatgtctactcatcacacccccc

SEQ ID NO: 5413 - DNA, 201 bp, Homo sapiens
caggtgaccccctccagccctgtaagtgccccaaggatggaaaatggctgccttcttgatctggtccttccctgtcctggagcaggaaggcaggccttaayctctccttctttcctgcagggaatagaacgtgtccgggctgtggccaagcggattggtgaggtccaggtggcttgtggcctgaaccagacggtggaggaa

SEQ ID NO: 5414 - DNA, 201 bp, Homo sapiens; identical to SEQ ID NO: 1516

SEQ ID NO: 5415 - DNA, 201 bp, Homo sapiens
gcctgacatgactggccaactggtcgacctgcctgaatattacagctggggggaggaactgacagagacccagcacatgatccaggtgagcaagtgtgagwgctgaggaggtgataggagaagggaagagaagatcgtgttactctaggtgctactaaacttagtccaagtgtctgtccctgtgatgcctcctcccatctg

SEQ ID NO: 5416 - DNA, 201 bp, Homo sapiens
ttgcccctctctactggtgagctctgcatggttgcttcctgattcctgcccaagggtgggtatctggtctctgcctttgatgtctactcatcacacccccstctcctggcctctctgaccacccccaggtctcctcgaactccaccagcagagtattcacaaccctggtcttgtgtgataagcccttgtcccaggacccac

SEQ ID NO: 5417 - DNA, 201 bp, Homo sapiens
ccggggggtatcaccaacatggtggctcctagttcaggggcagggcccaagacatctttctccactgttaccacccggggttcacacgccgtccacactgyacccaaccccaccccttcaggtctgcctactcttgtctttggctttccctaccccttgcttaaaccaggctgctgtccaagctcccgctggtcgggatca

SEQ ID NO: 5418 - DNA, 201 bp, Homo sapiens; identical to SEQ ID NO: 1518

SEQ ID NO: 5419 - DNA, 201 bp, Homo sapiens; identical to SEQ ID NO: 1519

SEQ ID NO: 5420 - DNA, 201 bp, Homo sapiens
atcagtcattgctgctgcttcctgagtaccatcagcgagtagaggtgggtggggcagtggttggggcaggggggctaggggacagcagtgtgtccaatgcycaccctttttcttgcaggtgctccgaaccctgggttacgtggacgaggcgggcactgtgaagctggcagggcgggtggcttgtgccatgagcagccatga

SEQ ID NO: 5421 - DNA, 201 bp, Homo sapiens
tttatcctctttccttacctaatgcctctcatcttgcccttgtttcagcttccccatggcctccctccttgtgccccagatctgcagcaagaagcagaacrgttgtttctgtcatccccagcctggctgcctctgcatggtgtggagcactcagcccggtgaggagtctggaggggcttagactagggtgatgggttcctg

SEQ ID NO: 5422 - DNA, 201 bp, Homo sapiens; identical to SEQ ID NO: 1521

SEQ ID NO: 5423 - DNA, 201 bp, Homo sapiens; identical to SEQ ID NO: 1497

SEQ ID NO: 5424 - DNA, 201 bp, Homo sapiens
cagtatcccttctggccaggtgactcttgtggagatgggatggtagaagagggtgtctttaatctccagggaagggttccccacctatctcgtattaccckcatcccatgaatccctgtctgtcctgtctcttcccaggggggatggatgaacccaccataacagatctgaacacacgggaggaggctgaggaggagatag

SEQ ID NO: 5425 - DNA, 201 bp, Homo sapiens; identical to SEQ ID NO: 1498

SEQ ID NO: 5426 - DNA, 201 bp, Homo sapiens
tggggcagtggttggggcaggggggctaggggacagcagtgtgtccaatgcccaccctttttcttgcaggtgctccgaaccctgggttacgtggacgaggygggcactgtgaagctggcagggcgggtggcttgtgccatgagcagccatgagttgctcctcactgagctcatgtttgacaatgcactgagcaccctgcgg

SEQ ID NO: 5427 - DNA, 201 bp, Homo sapiens
cccagtcccatccgacctacaggcccaaagacacccaaccacaggccagatactgggttacaaagaggtaggaggtcaggggtcatgagaaacagttgggkagaaggggaggtggtcagagacaagctcagcctcattggggctctgatctcttgccttaggtcttgctggagaacacaaatctctcggctacaacctcct

SEQ ID NO: 5428 - DNA, 201 bp, Homo sapiens
ttcagaaacaggccatcctgcacttggaacggcatgactctgtctttgtcgcagctcacacatctgcaggaaaaacagttgtggctgaatatgccattgcyctggcccagaaacacatgacacggtatgagttcctttgccaacctcccccttcaccagccagccccattttctcctgcatcctttgaaaatctcatctct

SEQ ID NO: 5429 - DNA, 201 bp, Homo sapiens
caaggccccgctcctttcttcagctcctgtctatttctctctcccatagtgggcatttgagccagatgtgtttcagaaacaggccatcctgcacttggaayggcatgactctgtctttgtcgcagctcacacatctgcaggaaaaacagttgtggctgaatatgccattgccctggcccagaaacacatgacacggtatga

SEQ ID NO: 5430 - DNA, 201 bp, Homo sapiens
cccatagcctccgcacacactctgacctcgatcatctctaggaaacccaaggatgtgtgggggaaccaaaaggaatggcctgtgggggagaggatgggaarggaagaatcccattcttaccgagggagccccagacagacttgccagtagcggcatccagcatgggctgttttcgggctatgttgactttgagctgtacag

SEQ ID NO: 5431 - DNA, 201 bp, Homo sapiens
acaagagcccagagagaaatgaaaagacatggtggggagaaagtttagaagaatgacctgggttagtttaggaaggggttggggacagaatttttctgggrttatatcatgcaggagaatgtaagggcagtttgggtgaagaagaggagcacctgagcttctggggcatgcttccacgagggctccatgtgggagaggaag

SEQ ID NO: 5432 - DNA, 201 bp, Homo sapiens
catgtttttgagaaaattagaaaaagatattctgtccataacaacctttactgtcatctgctgggaaatttctacaacaacctttactgtcatctgttggraaagtgtcatagcaaacatccctatctacagcatctgtcctgtaaatggtatcttttaggtttatataatgtacacaatttgttcaccagtgtgcagtga

SEQ ID NO: 5433 - DNA, 201 bp, Homo sapiens
cttctcctaaggaacagagatggacatgacaaggttgaccttgttggcttgctcctcagattgtccaactccagctcctggactactaagccttagctgtmtgttggagcctctggatttgggtgggggtgacgaggatgagaatgaggcagtgggacagccaggaggtcccagaggggacactgtttcagcctctccctg

SEQ ID NO: 5434 - DNA, 201 bp, Homo sapiens
accagaagttccgggacttccgaaacacattcggggatgtggggctgctcaccggggatgtacagctgcatccggaggcctcctgcctcatcatgaccacrgagatccttcggtgagagatggacactcaatacaggggagttttggctgggaagatgtggccgttgtggagagtgtgctgtctgaggagtgggtggagac

SEQ ID NO: 5435 - DNA, 201 bp, Homo sapiens
tcctggcctctctgaccacccccaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaaggtgagagtgtggcagatgtctgttttct

SEQ ID NO: 5436 - DNA, 201 bp, Homo sapiens
agtaggatctagcttaaccttgttcatctgtgcctgtactcctgtccatcccagcctgaaggggtgctggacagattacagcccagtgtacctgcagtacrtgtgaggacagagcagaaagggctggggatatttttgctttgagagctgctctttcaaatgtggcatttctccgtggagctcccttctgtatccaagcac

SEQ ID NO: 5437 - DNA, 201 bp, Homo sapiens
tggagcaggaaggcaggccttaacctctccttctttcctgcagggaatagaacgtgtccgggctgtggccaagcggattggtgaggtccaggtggcttgtsgcctgaaccagacggtggaggaatttgtgggggagctgaattttgggctggttgaggttgtatatgagtgggcccggggcatggtgagtacctgaggttt

SEQ ID NO: 5438 - DNA, 201 bp, Homo sapiens
taggtcttgctggagaacacaaatctctcggctacaacctccttgtctcttcgccggcctccagggccagcctcccagtccttatggggaaatccaactcrgtatcccttctggccaggtgactcttgtggagatgggatggtagaagagggtgtctttaatctccagggaagggttccccacctatctcgtattaccctc

SEQ ID NO: 5439 - DNA, 201 bp, Homo sapiens
catagcaaacatccctatctacagcatctgtcctgtaaatggtatcttttaggtttatataatgtacacaatttgttcaccagtgtgcagtgacctgattycatgtccctatcctacagatcttcttactattccacctggtttcaagaaaggcatggactttgcaccaaaaggttagttttagtttttgagtggggtgta

SEQ ID NO: 5440 - DNA, 201 bp, Homo sapiens
gagcaggaaggcaggccttaacctctccttctttcctgcagggaatagaacgtgtccgggctgtggccaagcggattggtgaggtccaggtggcttgtggsctgaaccagacggtggaggaatttgtgggggagctgaattttgggctggttgaggttgtatatgagtgggcccggggcatggtgagtacctgaggtttgg

SEQ ID NO: 5441 - DNA, 201 bp, Homo sapiens
tcatgaccacagagatccttcggtgagagatggacactcaatacaggggagttttggctgggaagatgtggccgttgtggagagtgtgctgtctgaggagkgggtggagacgagccactggggagtcaatccttggcctcttctccccagctccatgctgtacagtggctcagatgttattcgggacctggagtgggtcat

SEQ ID NO: 5442 - DNA, 201 bp, Homo sapiens
ggtgagagatggacactcaatacaggggagttttggctgggaagatgtggccgttgtggagagtgtgctgtctgaggagtgggtggagacgagccactggrgagtcaatccttggcctcttctccccagctccatgctgtacagtggctcagatgttattcgggacctggagtgggtcatctttgatgaggttcactatat

SEQ ID NO: 5443 - DNA, 201 bp, Homo sapiens
tgcatgttgaaatgggatgagatgttgggggatagccttccattctgggtctcagaaaagactgggtaaagttggaggggtagggaagggggtggggatgygggttccttcccacgttcccacccctgacctgcttccctctcctttcttcaggcggctgaagcgtcgtcagatctatgtgattagcactgtaacccgccc

SEQ ID NO: 5444 - DNA, 201 bp, Homo sapiens
caaggagatcgtggagatgctcttcagccgtggcctggtcaaggtgcatgtggtggtggaaagggactcctcagggtgcttgttgcccacttaggggctgyccagagggcagaggggcagaggtttaggcaggccagtgctgtggttaagaatctgggctctggattcagactacctgggtttgaatcccaggtacaccat

SEQ ID NO: 5445 - DNA, 201 bp, Homo sapiens
ctcccatgtgaatatggagctagatggggcctttgagtccatttatttcagtttgctcccttatgttacagaagaggtgagcaagtggtttgtccaaggcyccatggttgcagagctaggaccggatctgacgggagtaggcccagtccagaagactggctggggttcagtaggtcccaccctgatctcagtgacttctgt

SEQ ID NO: 5446 - DNA, 201 bp, Homo sapiens
ggcagatgtctgttttctgccagcagtataagcaggatgcctgggtccatggcaatgtctgccctgctctccccttttcacagggccttgtgaccacaccrtggtcaagctccagccaggagatatggctgccatcaccaccaaggtgctccgggtgaatggggagaagatcttggaggacttcagcaagaggcagcagcc

SEQ ID NO: 5447 - DNA, 201 bp, Homo sapiens
tgaaggttggtggttctgtgtagtggaggcaagaaagagccttgccaccaggatgtgggctggctaggatgggtctgaggggaagaaagggacatcttttkggaggagtgctaattgagagccctctggttgtatctttatcactgctacccctgactcttccaggaagcgtccacagctgtatccaccccagaggcccca

SEQ ID NO: 5448 - DNA, 201 bp, Homo sapiens; identical to SEQ ID NO: 1517

SEQ ID NO: 5449 - DNA, 201 bp, Homo sapiens
aggtgagaactgggagggttttgtacctgccagcacctgtttttcctcctatcttttttttccccttgtcccccaggggttttgacttgagctttgagcaytgccccagttaacactagctcacctctcattggttcaggaactcaacctctgctccttccccttccccttccttctccaggaccgcggagtgtacctgtc

SEQ ID NO: 5450 - DNA, 201 bp, Homo sapiens
ccgcagggtgctcagtgcattgtcaaacatgagctcagtgaggagcaactcatggctgctcatggcacaagccacccgccctgccagcttcacagtgcccrcctcgtccacgtaacccagggttcggagcacctgcaagaaaaagggtgggcattggacacactgctgtcccctagcccccctgccccaaccactgcccca

SEQ ID NO: 5451 - DNA, 201 bp, Homo sapiens
catgtcttcttttgtgagcttgtagtttataattcatataaaaagtggttatatatctgatttttttttgcttctttttctccacctagtgtttcaacatytgtccatgttcctgtggccacatctaacccactgcttccaactgctgcagaacactctatgggtgcatcccccacactaaccttccctctctcccagtga

SEQ ID NO: 5452 - DNA, 201 bp, Homo sapiens; identical to SEQ ID NO: 1620

SEQ ID NO: 5453 - DNA, 201 bp, Homo sapiens; identical to SEQ ID NO: 1622

SEQ ID NO: 5454 - DNA, 201 bp, Homo sapiens
tggtactggcgttgagcatccagggagaagcagcccagttccgaagggcgccggtagaaaggaaagggcccagagtagagggcagggtctgtgggcagagwaggtgctggacgaggtagtttgttccgaggctcagctacctctgtcttctcagctcctctcttggtccccctgggatccatgaggtcctaagacaagcag

SEQ ID NO: 5455 - DNA, 201 bp, Homo sapiens
tcctccaccctgagggcatccactcgcagcaagttgaggatcatagtgtacgtgaggcggaactgggactgcagctgggacggcttcccctggagtcaggycacagaagtcactgagatcagggtgggacctactgaaccccagccagtcttctggactgggcctactcccgtcagatccggtcctagctctgcaaccatg

SEQ ID NO: 5456 - DNA, 201 bp, Homo sapiens; identical to SEQ ID NO: 1623

SEQ ID NO: 5457 - DNA, 201 bp, Homo sapiens
tcactattaaccttctacctgctaaatccaatggacagatttcagttctgggtttttttgttgttgttttcatttttttagagacagggtctccctctgtyacccagcctggagtgcagtcgtgcaatcatagctcactgcagcctcaaattcctgggctcaagcactccttctgcctcaacttcccaaacagctagaaca

SEQ ID NO: 5458 - DNA, 201 bp, Homo sapiens; identical to SEQ ID NO: 1614

SEQ ID NO: 5459 - DNA, 201 bp, Homo sapiens
ctcttactacaacctccacttcacagtctcccttaggctgggggagccccctcactacaaccccaccacttcatggtctccctcaggctggaggaaactcscagaccactgcccctccctgcctctacgtgcccctctggaggagaagggcctccctagcatctctgacttgaattttggctgctgcctcttgctgaagtc

SEQ ID NO: 5460 - DNA, 201 bp, Homo sapiens
gggtgctcagtgcattgtcaaacatgagctcagtgaggagcaactcatggctgctcatggcacaagccacccgccctgccagcttcacagtgcccgcctcrtccacgtaacccagggttcggagcacctgcaagaaaaagggtgggcattggacacactgctgtcccctagcccccctgccccaaccactgccccacccac

SEQ ID NO: 5461 - DNA, 201 bp, Homo sapiens
agtagcgcagggctcgggcatctccatggtactggcgttgagcatccagggagaagcagcccagttccgaagggcgccggtagaaaggaaagggcccagaytagagggcagggtctgtgggcagagaaggtgctggacgaggtagtttgttccgaggctcagctacctctgtcttctcagctcctctcttggtccccctgg

SEQ ID NO: 5462 - DNA, 201 bp, Homo sapiens
agaaaacagacatctgccacactctcaccttcaggcaggaacagcttgaatcccacgaggtcatctggatagggcacctctgcagtggctggccccctgtyctgtgggtcctgggacaagggcttatcacacaagaccagggttgtgaatactctgctggtggagttcgaggagacctgggggtggtcagagaggccagga

SEQ ID NO: 5463 - DNA, 201 bp, Homo sapiens
tcagaccttcagcctgtaactcctgcctctcaggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggct

SEQ ID NO: 5464 - DNA, 201 bp, Homo sapiens
agaagctcctcttcatcatgtcctccaccctgagggcatccactcgcagcaagttgaggatcatagtgtacgtgaggcggaactgggactgcagctgggayggcttcccctggagtcaggtcacagaagtcactgagatcagggtgggacctactgaaccccagccagtcttctggactgggcctactcccgtcagatccg

SEQ ID NO: 5465 - DNA, 201 bp, Homo sapiens
aaacctcaggtactcaccatgccccgggcccactcatatacaacctcaaccagcccaaaattcagctcccccacaaattcctccaccgtctggttcaggcsacaagccacctggacctcaccaatccgcttggccacagcccggacacgttctattccctgcaggaaagaaggagaggttaaggcctgccttcctgctcca

SEQ ID NO: 5466 - DNA, 201 bp, Homo sapiens; identical to SEQ ID NO: 1626

SEQ ID NO: 5467 - DNA, 201 bp, Homo sapiens; identical to SEQ ID NO: 1627

SEQ ID NO: 5468 - DNA, 201 bp, Homo sapiens
cagccgcgcgcgccgaccctgggcagataaatcggctcacggacagggaactggggcggggacgcggttctaacaaaactctcggctaccggaagcgaggmcccacccccggggttgccatggttacctggctcaccccgaagaggatccgactccacaggccctcgcttccgccgcctcttaactccaaaggtctccggg

SEQ ID NO: 5469 - DNA, 201 bp, Homo sapiens
ccaaacctcaggtactcaccatgccccgggcccactcatatacaacctcaaccagcccaaaattcagctcccccacaaattcctccaccgtctggttcagsccacaagccacctggacctcaccaatccgcttggccacagcccggacacgttctattccctgcaggaaagaaggagaggttaaggcctgccttcctgctc

SEQ ID NO: 5470 - DNA, 201 bp, Homo sapiens; identical to SEQ ID NO: 1628

SEQ ID NO: 5471 - DNA, 201 bp, Homo sapiens
tcagtgcattgtcaaacatgagctcagtgaggagcaactcatggctgctcatggcacaagccacccgccctgccagcttcacagtgcccgcctcgtccacrtaacccagggttcggagcacctgcaagaaaaagggtgggcattggacacactgctgtcccctagcccccctgccccaaccactgccccacccacctctac

SEQ ID NO: 5472 - DNA, 201 bp, Homo sapiens; identical to SEQ ID NO: 1629

SEQ ID NO: 5473 - DNA, 201 bp, Homo sapiens
ttcctccaccgtctggttcaggccacaagccacctggacctcaccaatccgcttggccacagcccggacacgttctattccctgcaggaaagaaggagagrttaaggcctgccttcctgctccaggacagggaaggaccagatcaagaaggcagccattttccatccttggggcacttacagggctggagggggtcacctg

SEQ ID NO: 5474 - DNA, 201 bp, Homo sapiens
ctggaatccctctgtgtgcatgaacttctgtgccgccttccttagctttgcccagagcacggttgtccaggatgaccccaggtgaggcattcagctctgtmcctcccctctggatcccaggatccagcctctggccctcaactgatgcctccatctgccccccaggctcgttcatctcttctcttgggagcctggcggccc

SEQ ID NO: 5475 - DNA, 201 bp, Homo sapiens; identical to SEQ ID NO: 1631

SEQ ID NO: 5476 - DNA, 201 bp, Homo sapiens; identical to SEQ ID NO: 1630

SEQ ID NO: 5477 - DNA, 201 bp, Homo sapiens
tcctctccctccctactgcactgacctaatttaggccttcaccacttctcagatgcagtatcttcttagctgacctccctgcctcatccactatctccaayacaccattccctctctctatgatattctctaccagcccatcgcctcagtgtaagatggaaacaacactgatgtacaaggcctgtcatgatctgacgtctg

SEQ ID NO: 5478 - DNA, 201 bp, Homo sapiens
cgtcccggggctggtatcgatccgggtatccgtctctgaggtcaaagttggggcctggaccgttagtggggggtgggctatagtagcgcagggctcgggcwtctccatggtactggcgttgagcatccagggagaagcagcccagttccgaagggcgccggtagaaaggaaagggcccagagtagagggcagggtctgtgg

SEQ ID NO: 5479 - DNA, 201 bp, Homo sapiens; identical to SEQ ID NO: 1632

SEQ ID NO: 5480 - DNA, 201 bp, Homo sapiens
gtcccggggctggtatcgatccgggtatccgtctctgaggtcaaagttggggcctggaccgttagtggggggtgggctatagtagcgcagggctcgggcawctccatggtactggcgttgagcatccagggagaagcagcccagttccgaagggcgccggtagaaaggaaagggcccagagtagagggcagggtctgtggg

SEQ ID NO: 5481 - DNA, 201 bp, Homo sapiens
ggctgctgcctcttgctgaagtcctccaagatcttctccccattcacccggagcaccttggtggtgatggcagccatatctcctggctggagcttgaccayggtgtggtcacaaggccctgtgaaaaggggagagcagggcagacattgccatggacccaggcatcctgcttatactgctggcagaaaacagacatctgcc

SEQ ID NO: 5482 - DNA, 201 bp, Homo sapiens; identical to SEQ ID NO: 1604

SEQ ID NO: 5483 - DNA, 201 bp, Homo sapiens
acctcccatcaccccccaagactccctctcccaaatagtaatgctttagagggaggcagtcatatctctgtgtgcagataataaaagcatatttctaagargttctctcgctgtcttcttagctgagtcatccctgtccagcaactcaagcacacaacagtgctttgctgttttatcatcatgtttttacatggggcattc

SEQ ID NO: 5484 - DNA, 201 bp, Homo sapiens
tcatccctgtccagcaactcaagcacacaacagtgctttgctgttttatcatcatgtttttacatggggcattcactgggtgtagaggctggccgcaaatmcgatgtcccgccgtagcaaggtagccgctgtctccatcttggcacccagcacaggctctcctaccaggcgggctgccccccgcagtgagcgacacatctc

SEQ ID NO: 5485 - DNA, 201 bp, Homo sapiens
ggacctcccatcaccccccaagactccctctcccaaatagtaatgctttagagggaggcagtcatatctctgtgtgcagataataaaagcatatttctaaraggttctctcgctgtcttcttagctgagtcatccctgtccagcaactcaagcacacaacagtgctttgctgttttatcatcatgtttttacatggggcat

SEQ ID NO: 5486 - DNA, 201 bp, Homo sapiens
tccctctcccaaatagtaatgctttagagggaggcagtcatatctctgtgtgcagataataaaagcatatttctaagaggttctctcgctgtcttcttagstgagtcatccctgtccagcaactcaagcacacaacagtgctttgctgttttatcatcatgtttttacatggggcattcactgggtgtagaggctggccgc

SEQ ID NO: 5487 - DNA, 201 bp, Homo sapiens
gggtggtcttgatctcttgaccgcttgatccacccgccttggcctcccaaagtgctgggattacaggcgtgagccactgtgcctggccgagagtagggctytcttgaggggtggccttgagtcaggagtgggctccaggtccctggagctgagttatctctgatgcttcaggagctgttgtcctgggttaccactgtggcc

SEQ ID NO: 5488 - DNA, 201 bp, Homo sapiens
ctgctcttcctggctcctgggtacctctcagctggctggagagcacaggcctcaaatgtgacagcgtcagaggcctatttttgtaccacatctggagtagragggctcctggaacctgattcggtcagcacagctgcttttacttctggcatggtgcatccacaggctgcaggatgtaggaagcagcctttgcttctaggc

SEQ ID NO: 5489 - DNA, 201 bp, Homo sapiens
gtgatagctgagctaagcctgagggggactaagatggctcagtgaagatagatgcttccttgatcacctatacaaacagatgtgatttcaaaaccgttagsctgggcaagggtgagctttcaccacatcaacaagtccttttatttcttccagatagaaacctgctaggcttctggctacccaagagagtttgctgtgcct

SEQ ID NO: 5490 - DNA, 201 bp, Homo sapiens
tatttttgtacccttacttacttttatttctggttgatccttaccttgaaagtgtagtctttgggattccagcttaaaatgggggtgttatcagagtcctyatctctgagggcccctgagcttcgactatcatctctcccaaccccagtcaaagcccagaatgttgcctaaaggacagcttttggccaagccaacagggcc

SEQ ID NO: 5491 - DNA, 201 bp, Homo sapiens
gggcttggcctcctgagcctaatgatgaggtatcaggccttgctctgttcccagtgggctggcctttcatgcatgctgctcatgtcctctgcattatctcyggacttgatgcctcagcctttctctcacacacttttctttccctccccaagagcctgaaaaagaagctaacgatgctgcaggaaaccttgaacctgccac

SEQ ID NO: 5492 - DNA, 201 bp, Homo sapiens
caaaggccccaggaaggtaagagctttctagaagaagcacagtctaacctttggcaggactggacttttgggagggcacggtcttgccagagccttgtcaytcctggtccaggactgaggtacttcggagccacccttgggattctactcattatccctcctgcctcctagtgaggcatcagagatcctgatcttgttcca

SEQ ID NO: 5493 - DNA, 201 bp, Homo sapiens
tgcctcttccttgacagctcctccagactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaa

SEQ ID NO: 5494 - DNA, 201 bp, Homo sapiens
ttttagtttatcagttactcctttaagcatactttggaactttatcctcagactctcattacctttagaattttctctgattttggctttctgcagttttrgtatagtgtatccaatatgaatttctttttacctttttcttttcttttttttttttttgagacagagtcttgctctgttgcccaggctggagcacagtgg

SEQ ID NO: 5495 - DNA, 201 bp, Homo sapiens
ggtatcccccaacatgtggacactgatgctcccctctgctcttcctggctcctgggtacctctcagctggctggagagcacaggcctcaaatgtgacagcrtcagaggcctatttttgtaccacatctggagtaggagggctcctggaacctgattcggtcagcacagctgcttttacttctggcatggtgcatccacagg

SEQ ID NO: 5496 - DNA, 201 bp, Homo sapiens
ccatattggctatacttgtgggttttgtactaggtagtttgaagagtcaaggccttcccagtacctcacagaggggatgctcaactaagacctcagtgagrctgggccatatttccgaaagtggttcatactctactgatgaggccagcctgaagaaccttccattagcactctagtccttggctgggctgctctcctgag

SEQ ID NO: 5497 - DNA, 201 bp, Homo sapiens
aatcatagctcactataacctcaaactcctgagttcaagggatctccccacctcagcctacctagtagctaggactgtaggggtgcaccaccatgctcggktaatttttttattttatttatttatttatttatttatttatttatttatttattttgagatgaagtctcactctgtcacccaggctggagtgtagtggcg

SEQ ID NO: 5498 - DNA, 201 bp, Homo sapiens
gggtgtcctgctctcatcttcctctgtggtattctgcttctgtcccccagcccatttatcacctctagacattgagatggggtgcccatgactatcccctycttggttttgtccacagccaaagacctggtcacaaggctgatggaggtggagcaagaccagcggatcactgcagaagaggccatctcccatgagtggtga

SEQ ID NO: 5499 - DNA, 201 bp, Homo sapiens
tcttctttgatcttgcccaggaggaggagaatgtcttggatgcagaattcttaaaggtacccagaatttatctgattctactgaactccaagccttgtgcragttcacttttcttttttcttttcttttcttttttctcttctcttctcttctcttctcttttctcttttcttttcttttcttttcttttctttttttaga

SEQ ID NO: 5500 - DNA, 201 bp, Homo sapiens
gtctcaaacttctgacctgatgatccacccgcctcgacctcccaaagtgctgggattacagacgtgagccactgggcctggcctgcctacttttaaactctgtgtaaatagaatcatacaaaatataactttttgtatctggcttctcttcctcagtgttatgtttttgtgatttattcataatattgttcttagctgtag

SEQ ID NO: 5501 - DNA, 201 bp, Homo sapiens
ggtctcaaacttctgacctgatgatccacccgcctcgacctcccaaagtgctgggattacagacgtgagccactgggcctggcctgcctacttttaaactctgtgtaaatagaatcatacaaaatataactttttgtatctggcttctcttcctcagtgttatgtttttgtgatttattcataatattgttcttagctgta

SEQ ID NO: 5502 - DNA, 201 bp, Homo sapiens; identical to SEQ ID NO: 1658

SEQ ID NO: 5503 - DNA, 201 bp, Homo sapiens
gagtggacagatggacaagcaggcttgcagtcagatggggtgggggcatgtgtctgtggcctttctgtgtgacccttcccccatgcaggctttcaggcaayccacctttctatgaggaggtggaagaagatgattatgagaaccatgataagaatctcttccgcaagatcctggctggtgactatgagtttgactctccat

SEQ ID NO: 5504 - DNA, 201 bp, Homo sapiens
atcgcttgaactcaggaggtggaggttgcagtgagccgagattgcaccactgcactcccgcctgggtgacagagcgagactcagtcttaaaaaaaaaaaaagtgtttttttggctaggcatgatggctcacccctttaatcccagcactttgggaggtggctggattgcttgagcccaggggtccaagaccagtctgggca

SEQ ID NO: 5505 - DNA, 201 bp, Homo sapiens
ccctatgttgtggggaagtggagagtagtacagctaagccagaccccattgtgcccgcaggttagagcctggcaatgccgtttgggtgtgtgactctgggygacaagaagaactataaccagccatcggaggtgactgacagatatgatttgggacaggtcatcaagacgtgagtgccgggcctgtcaggcaaggctgggt

SEQ ID NO: 5506 - DNA, 201 bp, Homo sapiens
gctattctcctgcctcagcctcccgagtagctgggactacaggtgcccgccaccacgcccggctaattttttgtatttttagtagagacagggtttcaccrtgttagccaggatggtctccatctcctgaccttgtgatccacccacctcggcctcccaaagtgctgggattacaggtgtgcgccaccgtgcccggccaag

SEQ ID NO: 5507 - DNA, 201 bp, Homo sapiens
gatggggcagtgagggttgcctaggcttggccatggctttggttccagctacctcttgttccctcacctgagcactcaatctgtgcaaaccccttctcttktctcattattcctcaccatcacctttcaaggcaaacgtattggaatgcaagttagagagaatgcagtgatgccagaaggggtgggtctgggctggagagg

SEQ ID NO: 5508 - DNA, 201 bp, Homo sapiens
ggcaggagggtgggagagtggatgaggggcttctcactgtacatagagtcactggcatgatgccctcgctcccccatgcccccacatcccagtggggcatwactaggggtcacgggagagcagtctcgtctcctgtgtgtatgtgtgtgagtggtgggcaggccagtggcagggccggccccagcccctgcatggattcct

SEQ ID NO: 5509 - DNA, 201 bp, Homo sapiens
agagcccaaggccttaccacccaagggggtgacccacaggggcaagcatgagaagctgtctggaattccagtggggcaggtggaacctgctctggggtacrgtgggaccagaaaaagggaggctgtctccttggccaggtttgccaagtgtaattcactgtggagacaaggactatactcattcatacaggtactgttcag

SEQ ID NO: 5510 - DNA, 201 bp, Homo sapiens
aagccagctgggctgtcctacctcccaaacctcagggggcatgggcacccctgttgtagagggcgaggcctggtagcaatgagaaacaaacctaggacccrtgggctgtagtcctcagggatcctgtcagtgtctgctgtgtactctggcttcctcccattgcccttcttccgctgtaaaggttgaaggtggacacctggg

SEQ ID NO: 5511 - DNA, 201 bp, Homo sapiens
aggcctggtagcaatgagaaacaaacctaggacccgtgggctgtagtcctcagggatcctgtcagtgtctgctgtgtactctggcttcctcccattgcccytcttccgctgtaaaggttgaaggtggacacctggggtcttcaggctgccaggcctttcagagacatttccaccaccttcatggcctgtggaggtagtgaa

SEQ ID NO: 5512 - DNA, 201 bp, Homo sapiens; identical to SEQ ID NO: 1656

SEQ ID NO: 5513 - DNA, 201 bp, Homo sapiens
tcagcggtggaacagctggctgtgtactgtgtgtctctcaagaagtgcgtactgtggcccctctcagcaaacacaggagataggccatggggccccagccrtgtcattgctccccatctcttgtaaagcagatggaactaaggggcaaactctggagccatgctgcctttgtttgaaccctgattccacctttcagcaact

SEQ ID NO: 5514 - DNA, 201 bp, Homo sapiens
cagcacagtctattcttgtgtttgtttgttggtttgtttgttggtttgtttgttttgagatagggcctcattctgttgcccaggctggagtgcagtggtgygatcacagctcactgcagcctcaacctcctgggctcaggtgatgtgatcctgcctcagcctcctgggtagctgggactaaagtgctgggattacgagcgt

SEQ ID NO: 5515 - DNA, 201 bp, Homo sapiens
tgctgccagtttcttggcctctttgaccctcaacttcctgaatggaaatagtagtagacctgcctcataggattgttgaggatttagtgtgaatcttaagygctgtttctaagggagttgacctagctctctgggctataagccccattgtgattgatatgtagagcctgttccccattagcactatgatcctgcctggct

SEQ ID NO: 5516 - DNA, 201 bp, Homo sapiens
ctggggctttctgcatgccctctcaagtcaccagtgcctgcaggacaggcaggaggaaatagtcacttccttgcattctctgcaggaccctccacagtgcyacctggtacttgttgggctcaggtgtcaaagtaggaatgagagtgagttgaggggttgggcagtgctttgtgttagattagtgctgtggctcagtctgac

SEQ ID NO: 5517 - DNA, 201 bp, Homo sapiens
aatctaaaagaggcacggaaggcctcaggggaggtggctgacaagctgaggaaggatttgttttcctccagaagcaaggtaacttagcagtgaacagaggytgaaggagaagtggctctccttttgtcatgttcactctggtctcctgagcaaggccatgggacctgatggcacagctgactccctggggcagctggagga

SEQ ID NO: 5518 - DNA, 201 bp, Homo sapiens
ttcactctggtctcctgagcaaggccatgggacctgatggcacagctgactccctggggcagctggaggacttacagaaatttgttaccagtccttactgsgcattggcctgaatatgtggcttgtccactaggggtggacagatcacagaggtatcccccaacatgtggacactgatgctcccctctgctcttcctggct

SEQ ID NO: 5519 - DNA, 201 bp, Homo sapiens
ctcagttagttgggtcgttatataccccatttccatttataagtggttatcctagaaattaaggtatgtatccttaacttaccaatttcaaggttaatcarcacctttctcattttcccaggcaactcaaagagcttagaatactaacattcttttcccacttctacgttattgttgaatattttaattgtgtgtatgtgt

SEQ ID NO: 5520 - DNA, 201 bp, Homo sapiens
ggtggagaggaggagtagtcgcccaaggtccttggccattcctattgtgtgtccctggtgagtcagctgatgcccagagggaatgagaccaacatagagcratgaggccaaggaagtgatagaaacttctgctatggagactgatcacaggggccctactttaacttcccttccactattctacctctttacctgtcctgg

SEQ ID NO: 5521 - DNA, 201 bp, Homo sapiens; identical to SEQ ID NO: 1657

SEQ ID NO: 5522 - DNA, 201 bp, Homo sapiens
ggctcatgcctgagggaggatcatctcaaaccacagagcccaaggccttaccacccaagggggtgacccacaggggcaagcatgagaagctgtctggaatwccagtggggcaggtggaacctgctctggggtacagtgggaccagaaaaagggaggctgtctccttggccaggtttgccaagtgtaattcactgtggagac

SEQ ID NO: 5523 - DNA, 201 bp, Homo sapiens
agagagggaagggaggtgactgaagctgttcacctagaccaggtgagcctcttgtctctgagtgcagcttcttgcccaggaaccaagatgggagggggttrcctgatgggactgaatatcttcgggagagggctcagctgctgagtttggctggaacctgcttgagtcctgggttgatgaactaactggacccatggcagg

SEQ ID NO: 5524 - DNA, 201 bp, Homo sapiens
gtatcttttgagcacttaaccgtgtaggtctgtagtaatatgacttcagtgaccacgaaaccagcagccccaacttggggtacctgcaggagtaaagaggkcttttgactctaaaggatgtactttgaaaaattaggtctgagaacaggcctgacatgcatgtcaggcaggtagtcagacccatgtacaacactctcctcc

SEQ ID NO: 5525 - DNA, 201 bp, Homo sapiens
gaggtcttttgactctaaaggatgtactttgaaaaattaggtctgagaacaggcctgacatgcatgtcaggcaggtagtcagacccatgtacaacactctyctccttgcgcatgacccagctacacaatcatactcttaccttgttctcccatccaggttggcaaaagaaccattatcaataagctcttctttgatcttgc

SEQ ID NO: 5526 - DNA, 201 bp, Homo sapiens
tcacttccttgcattctctgcaggaccctccacagtgctacctggtacttgttgggctcaggtgtcaaagtaggaatgagagtgagttgaggggttgggcrgtgctttgtgttagattagtgctgtggctcagtctgacctgcaggtgttcttttctggcatctctttccatggccacattgcagagagtacgagaatcta

SEQ ID NO: 5527 - DNA, 201 bp, Homo sapiens
gccctgtggactgctgggccattggagtcatcatgtacatcctgtgagtggacagatggacaagcaggcttgcagtcagatggggtgggggcatgtgtctstggcctttctgtgtgacccttcccccatgcaggctttcaggcaacccacctttctatgaggaggtggaagaagatgattatgagaaccatgataagaatc

SEQ ID NO: 5528 - DNA, 201 bp, Homo sapiens
agtaggtcctcaggttttatgggtacagaattcatagggaggtattgccccagaactggactccccattctgggcttatcttctggttctgctccagtcawcaccttggtttggggagttgtaaaatagaggcaaatcacttcttccccttgcccttccatactgtacccatccatcccataagaaaagggccatattggc

SEQ ID NO: 5529 - DNA, 201 bp, Homo sapiens
ccagcctgggtgaagtcccctaaatttccctctcccactattaggtaggagttcacctgtttttccaggacccagcatgggcctggcacggggagtaagakgcacagggagtgagtgagtgctgcagtggaggttgcccagctgatctctagcatatctggaggagtatggggctttgtggcaaggaggtgccattcttgg

SEQ ID NO: 5530 - DNA, 201 bp, Homo sapiens
tttggttagactagaaattaagctcgcctctaagcgtactctattttctgtttgcctactctattttcttctatccttttactttatttatttatttttaytttattttatttttgagatggagtctcgctcctgtcgtgtaggctggagtgcagtggcgtgatctcggctcactgcaacctccacctcctgagttcaagt

SEQ ID NO: 5531 - DNA, 201 bp, Homo sapiens
gtttcactatgttggccagactggtctcaaactcctgacctcgtgatccgcccacctcggcctcccaaagtgctgggattacaggcgtgagctaccgtgcstggcctatcttgtctaatttaaagtccattttatctgctattagtatagccacttcagctgtcttttggtgactgcatggtatatcttttttcatctgtt

SEQ ID NO: 5532 - DNA, 201 bp, Homo sapiens
accagcacagtctattcttgtgtttgtttgttggtttgtttgttggtttgtttgttttgagatagggcctcattctgttgcccaggctggagtgcagtggygtgatcacagctcactgcagcctcaacctcctgggctcaggtgatgtgatcctgcctcagcctcctgggtagctgggactaaagtgctgggattacgagc

SEQ ID NO: 5533 - DNA, 201 bp, Homo sapiens
gcagtaggattacccttcatacctgtcattttagggaggcatcagcatgtagccaccacccccaactacagagtcaatgttaggaagatctctctcatggrccccaagggcccctgaactccaggctagagacagccagggagacctttccttagggtagggtaaggccgccaggagccatgagttcatggaggagatgtt

SEQ ID NO: 5534 - DNA, 201 bp, Homo sapiens
cagtgcaactgaggtgcatcatcccagtctaccgtggaaagctttgcagtttggaggcagaaaataatgtacaggcctgggatgctctgcggtggggaccsggggcatctggttgtacccgctccccggctccaagctgtctgactcccaccgaggctgaggacctggagtcagagtgggtcttgtcagcaggtgataggc

SEQ ID NO: 5535 - DNA, 201 bp, Homo sapiens
gtttggaggcagaaaataatgtacaggcctgggatgctctgcggtggggacccggggcatctggttgtacccgctccccggctccaagctgtctgactccyaccgaggctgaggacctggagtcagagtgggtcttgtcagcaggtgataggcacgaatcaaaaccttatccacaaggacaggcccccaccctgtgtgtgg

SEQ ID NO: 5536 - DNA, 201 bp, Homo sapiens
cccagagctgagggtgctcagtgtggatggatgtttggctcagcaaggtctcagcaaccgggtgacagatggaatacaagggaagcaggaatcttctcccragaaccatgcaccccccattcccagagatcagggtgaacagtgccccacctctgacagtctggaggtgtcgtcccaagaggcaccagctggtcactgggt

SEQ ID NO: 5537 - DNA, 201 bp, Homo sapiens
agctagcacagcctgctgggcagggatctgtggcttttggagtacattttatgtccacttgaggagtgagtagcattggcagtgggggcattgcttgccakggctatcccctggcaggggctgggcaatcaagacagggagggcttgggggactcctgggtttcccttcgggcaggcacattctgcaacaagcccagaatg

SEQ ID NO: 5538 - DNA, 201 bp, Homo sapiens
ttgtgcctgggacgccatgtcaatatttgcggtgctggattagtcagggctctacctctgacccggcgccagctgggctggcttccattccctccaggtgkgtacgggcctgggagtggctcctgtggggtccggttgcttttgggcaaggaggggcagtacaagggatgctggtcctacaagtgagatcctgagtgcccg

SEQ ID NO: 5539 - DNA, 201 bp, Homo sapiens
gggtacgggcctgggagtggctcctgtggggtccggttgcttttgggcaaggaggggcagtacaagggatgctggtcctacaagtgagatcctgagtgccygtcttatcctgacaatttgtctcatgcatatagtcatatcacttcatttccctgagcctcagtctcctcacctgtaaaatgggaacaataatggctaatg

SEQ ID NO: 5540 - DNA, 201 bp, Homo sapiens
ccgtcttatcctgacaatttgtctcatgcatatagtcatatcacttcatttccctgagcctcagtctcctcacctgtaaaatgggaacaataatggctaaygcaggccaatgtctagcacacagaaggtttccagtacattacagctattgtcacattattactattactgatactattattatcatcattacaatgatta

SEQ ID NO: 5541 - DNA, 201 bp, Homo sapiens
gaatctgttctgccttttcctttgtctgcaactgaagattgtccctttggtctggtcctcattctcgtacccctatctgtttcttatttaggggagttagragctttacatcatatcttacagatttctgtaaaatcaggaacaaaagggctgaggatgagcatggagactctttttgcagcatagagtcgcagggagccg

SEQ ID NO: 5542 - DNA, 201 bp, Homo sapiens
aggccccggcccagttaactcaccacccctgcagggtgagccagaacgtgcctcgctgccacaggattggctgttacctctcccgagaccggcccggcttyctccctccctccctccctccctccctttgtttaggtctgtgctcctctgcttcccccagagacgcctcccctgctgactgctgtagctagccttgcccca

SEQ ID NO: 5543 - DNA, 201 bp, Homo sapiens
gatggggtttcaccgtgttggccaggctagtctcgaacccctgacctcagagaaaccacccaccttggcctcccaaagtgctggaattacaggtatgagcyaccacgcccagccttctctctccatttttggcaaatcaaattcatctgtctcagactcctcatatacacccagattagagggaaatttaatctccctcct

SEQ ID NO: 5544 - DNA, 201 bp, Homo sapiens
gcgagacccccatctccacaaaaaaaaaaaaaaaaattaaaaagtggctgggcgtggtgactcacgtctgtagtcccagttacttgggaggctgaggtggraggattgcttgagcccagaaggtcaaggctgtagtgagctatgatcatgtcactgcactccagcctgggtgacacagcaagattctgtctctaaacctat

SEQ ID NO: 5545 - DNA, 201 bp, Homo sapiens
gacatagcctaaggtattgaccatgcctctctattggtcattatttcacttccaaatttttgccactataaataatatgatgacaaaaatcttcatatgtwattctttgctcggggttcttagaactagaataaatggatgaaggcgtattcccacttttattgcttttttcacatttagccaattttccttctgaaaggt

SEQ ID NO: 5546 - DNA, 201 bp, Homo sapiens
aggctgggctccaggtggcatttcccactcttgtccggtgctggatggctgtcggcatctctgtggtcccatgtcctgcacacacaaccgtagtttccacragcgctctgcagacctcccgcctgccgggctgcctgcgcttctcaccaagcacacctcacagataggggcctcctgaaccttttaaagtggttccctccc

SEQ ID NO: 5547 - DNA, 201 bp, Homo sapiens
actcaatcttgctctgaacaagattctttaatctgctatgatattgagtataagaatcagctctgtagcttggtaacaaaaattcacactgagctgtgttygcattggtttagctctcagacagactcctgattaaacaaacagaagttctgaaagggttatgttatggatgcccaggggatgaggaggaaagggaggact

SEQ ID NO: 5548 - DNA, 201 bp, Homo sapiens
ttaatgaatgagtgaatggatgatgccctcactcttgccctcctgtgcatcgtgtctctccgctttgctgcaggatggcatttcaggacttcaaggcccamtttgataaagtggagatctgcaacctcactcccgatgccctggaggaagacgcgatccacaaatgggaggtgacggtccatcagggaagctgggttcgcg

SEQ ID NO: 5549 - DNA, 201 bp, Homo sapiens
atgcaggacactcacacgtagacaatgctcccaagtgcacatgcaaccagcatacatgtggagcatgcacaagcacacacgtgtaccacacctgggcacayacaacaaggcaagtcacaggcaccttgcacatgtgggcatgtgggccgtcagcatacacaccactcccaggcatctaacccaggcccaccgcctagctgc

SEQ ID NO: 5550 - DNA, 201 bp, Homo sapiens
ccactgacatggtcctggtttgcattgtccttctgggctcagctcagagccacctgcaaactcctgcgctagccaaggtggaggaggaagaagagcagtgygcttcctacagatgagaggggtccgcacaggcaagccaagccaggaccccagaactgagcagctgccccccaccttcactccctttccagccaccacgga

SEQ ID NO: 5551 - DNA, 201 bp, Homo sapiens
cttacttaggtgggtgacctcagacaattttcttagtgacattaaacctttctacactcgtctgaaaaaaggagagactgacagttccctgcaggcttccygtagagctaaatggcatcacacacaggagccggcacagagccaggcaccgagtaggcattccttgaccttccaccccagacagtgtcaccttctcctgac

SEQ ID NO: 5552 - DNA, 201 bp, Homo sapiens
cttagtgacattaaacctttctacactcgtctgaaaaaaggagagactgacagttccctgcaggcttcccgtagagctaaatggcatcacacacaggagcyggcacagagccaggcaccgagtaggcattccttgaccttccaccccagacagtgtcaccttctcctgactcacaggccaccactcagggccagcccgttt

SEQ ID NO: 5553 - DNA, 201 bp, Homo sapiens
tgtgcatcgtgtctctccgctttgctgcaggatggcatttcaggacttcaaggcccactttgataaagtggagatctgcaacctcactcccgatgccctgraggaagacgcgatccacaaatgggaggtgacggtccatcagggaagctgggttcgcggctccacggctgggggctgccgcaatttcctgggtaggtaggc

SEQ ID NO: 5554 - DNA, 201 bp, Homo sapiens
gcaccgagtaggcattccttgaccttccaccccagacagtgtcaccttctcctgactcacaggccaccactcagggccagcccgtttcttctgtccctgargcctgcaatctgataagcagaggtactctcaagccctgtcaccaatagcacagaagtgtttcaaaggcaaagagagtgagcaggtcacatgtagctcagg

SEQ ID NO: 5555 - DNA, 201 bp, Homo sapiens
aacagttctggcagcacagtgagtggctggacgtggtgatcgatgaccgcctgcccaccttcagggaccgcttggttttcctccactctgccgaccacaaygagttctggagcgccttgctggaaaaagcctacgccaagtgagtgacagcttccccagctcaggcagcctcccgacaggagtctctacactagtctttgt

SEQ ID NO: 5556 - DNA, 201 bp, Homo sapiens
gggaccgcttggttttcctccactctgccgaccacaacgagttctggagcgccttgctggaaaaagcctacgccaagtgagtgacagcttccccagctcargcagcctcccgacaggagtctctacactagtctttgtagtgagcatctaagggctgggaaaaaatcagggctctgggtttgcaggtgaggctcggcagga

SEQ ID NO: 5557 - DNA, 201 bp, Homo sapiens
gctggttcccggggcgtgtggggccagagctggcttgtgcagacatgtgaaggagtggcctgtctactatcctcccgggctctgactcaggatcctgtccygattctgaggtgccccttcttcctcccctttcagccctcaggcccaccttgcatcaaggttgattctcaagaaagacttttacaacagcactctaacttt

SEQ ID NO: 5558 - DNA, 201 bp, Homo sapiens
ccggaacccttggggccaggttgagtggaacgggtcgtggagcgacaggtcagtcaccctatcctgcctctctggctggttcccggggcgtgtggggccaragctggcttgtgcagacatgtgaaggagtggcctgtctactatcctcccgggctctgactcaggatcctgtcccgattctgaggtgccccttcttcctcc

SEQ ID NO: 5559 - DNA, 201 bp, Homo sapiens
gagaaaatagcttttgaatcagtagactgagtaaagaggattgctgccaccaatgtggacgagcattattcagtttgctaaagatccaaataaaagaaaaygacaaaggaagggtgaattccctttccctacttgaactgggacatccatattcccctgctcttggacattggagctcctcgttctcaaacctttggactc

SEQ ID NO: 5560 - DNA, 201 bp, Homo sapiens
cccatttcccccagccccaggcaaccactcatctactttctctatagattctatttacatattctgaatattttatataaaaggaatcataggccgggtgyggtggctcacgcctgtaatcccagcactttgggaggccgagacaggcggatcacctaggtcaggagttcaagaccagcctggtcaacatggtgaaacccc

SEQ ID NO: 5561 - DNA, 201 bp, Homo sapiens
ggaaagaaggaagggagagagggaggaagggagggagggaggatggaaggaaggaaggaaggaaggaaggaaggaaggaaggaaggaaggaaggaaggaarggagaaaatatactattccaggatttgaaacccgcatatacagagggctgacttggtataggcagattccacagggcttactgtgggacttgagtatgca

SEQ ID NO: 5562 - DNA, 201 bp, Homo sapiens
gctgggaagttcagtaggtcagtcaataaatcttgaaaatgcaagataatttaaagcaaatggagccaccacggagataccattatctgtaattaagctgwgtctgggttggggctgcagggagatttctaaccaccctcccaagtactgccgaaccacttgggtggcagctatgaaatgtctgctcgcccagcccgtgct

SEQ ID NO: 5563 - DNA, 201 bp, Homo sapiens
atgagggcaggtgcatttccacactgcctggtaaccctagaaaaaaatgtcatcagatctgtgtgacatatggtcctaaaccatgctaaagccacattttatcatggaataacagctaaatgcctcagaagaacattaacggcattgcacggtgaatccttatggagcatacatttaaaactataagtgatgttttggcaa

SEQ ID NO: 5564 - DNA, 201 bp, Homo sapiens
caacctcccttcctgttcccagcagaccacacacaagctcatacacatgcatacatgtgctcaaacacacacgtgtgtagaagcacttgcaaacacatgcrtgcacacatacatgcacacacatgcacacatgtgagcaaacacatgctttcacacatgcaatgtataaataaaccacaaacagtgcacatacctgtcatg

SEQ ID NO: 5565 - DNA, 201 bp, Homo sapiens
tggggttcctgaattatgaaaggggtcacctggaggggtgatatctaaacctaggggctgtctgatggtagtatattaggcactgcaataaacaggcaagrcagggagattaggggaccacaggatcggatggagaaaatgggggctcatgtgactgcttaaagcacagcaggaaggtggctgagcgcagccctgggcggg

SEQ ID NO: 5566 - DNA, 201 bp, Homo sapiens
gtgctaaatgactagttaatgggtgcagcacaccaacatggcacaggtatacatatgtaacaaacctgcacgttgtgcacatgtaccctaaaacttaaagwataataaataaataaataaataaataaataaataaataaataaataaaaaataaaataaaataaaataaaaataaataaataaaacacaagttttaacca

SEQ ID NO: 5567 - DNA, 201 bp, Homo sapiens
tgctaaatgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaa

SEQ ID NO: 5568 - DNA, 201 bp, Homo sapiens
gagcccaaagaagcttggaataggcccagacgctttgttttttagttctgttttgctttagacagagtctcactcttttaccctggctggagtgcagtggyataagcctagctcactgcagcctcaaactcatgggctcaagagatcctatcacctcagcttcctgagtagccgggactataggcacatgccatcatgctt

SEQ ID NO: 5569 - DNA, 201 bp, Homo sapiens
ctaaatgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagc

SEQ ID NO: 5570 - DNA, 201 bp, Homo sapiens
tgaagtgggtagacttttaattgtattttaagaaatctaatcaatgaaaagaaaaccagagaggcagggagatgttttttactgtggactcaggggaacayattacatctcccctatgttatgtggtgtggaaggggtgacatgggggtggctttaccctcgtccaagggctggaggactcgcaagaggccctgagatact

SEQ ID NO: 5571 - DNA, 201 bp, Homo sapiens
aatgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagcatg

SEQ ID NO: 5572 - DNA, 201 bp, Homo sapiens
cctcctggagaccaagatgtgtgtgttctagtctgtgctcttctagtccacaaggacctggcatgggagtgaggtgggtgcttggtataaagttctgttcsatgtcatcttcctctgtgctactgtcaactgaaataacaaacacagagacactctctaaaagaaaagctatttatttagggataaagcactgcaatggga

SEQ ID NO: 5573 - DNA, 201 bp, Homo sapiens
atgactagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagcatgg

SEQ ID NO: 5574 - DNA, 201 bp, Homo sapiens
agaacttctactagggctatgcagatggggaaatgtgaggttcaaggtctcgcacagagtccccactggggtactgcctagtggaactgtgggaaggcggycatcatcctccagacccaagaatggtggatccactggcagcttgcaccttgagcctggaaaagccacaggtactcaacaacccatgacagcagccaaagt

SEQ ID NO: 5575 - DNA, 201 bp, Homo sapiens
tgggaagaggtgggaaaaatccttcactcctctgcaggccccggcccagttaactcaccacccctgcagggtgagccagaacgtgcctcgctgccacaggwttggctgttacctctcccgagaccggcccggcttcctccctccctccctccctccctccctttgtttaggtctgtgctcctctgcttcccccagagacgc

SEQ ID NO: 5576 - DNA, 201 bp, Homo sapiens
acttccctcatgcttttcccttctaggtaagcttccgaggccagagaatcgagctcatccgaatccggaacccttggggccaggttgagtggaacgggtcrtggagcgacaggtcagtcaccctatcctgcctctctggctggttcccggggcgtgtggggccagagctggcttgtgcagacatgtgaaggagtggcctgt

SEQ ID NO: 5577 - DNA, 201 bp, Homo sapiens
acaccactcccaggcatctaacccaggcccaccgcctagctgccccttccacacatgcgtccgcagaaccccctgtgactggcacgtgtgcacaccaattmccagaaacactgacccacagaggagtcggtcacacatccagacacctccccaatttatacccgatggctaatttgtgtttacttggagagtttctgagtt

SEQ ID NO: 5578 - DNA, 201 bp, Homo sapiens
aacccagctctctcctgtcctctacagcaagcccgccagttcctcttctcccttactctctcgactccactcagctatgagtgtgccccaccaccccactmaccctgatcttgccagggacgccaccgactctcactttgctcgatcagattatcttgatccatcaggagcccttgacgtgctggattgcgggggaccaca

SEQ ID NO: 5579 - DNA, 201 bp, Homo sapiens
tgtgaccgggccaggcatgtagctgggtctgatccagcaggggaggcttgacttagacggtgggtgtgactctgctctttccatgttttagaccagaagtrctgcagaatctgaggcccggacgccgtttggtcttattaagggtcatgcctacagtgtaacgggaattgaccaggtaggcgacttgaactccaactgcag

SEQ ID NO: 5580 - DNA, 201 bp, Homo sapiens
ctccagcctgggtgacacagcaagattctgtctctaaacctatatatatttggaatccactttgtgggggaaggattatataaagaaagaaatggagaagmtgggtgggtagggagtatgtttagtccaaggccccagcctgtggtacatgcattactcagctccttgaagcccacagaggtcacagagctcacagctggg

SEQ ID NO: 5581 - DNA, 201 bp, Homo sapiens
gcagcagaaggggctggaggttgtgaccgggccaggcatgtagctgggtctgatccagcaggggaggcttgacttagacggtgggtgtgactctgctcttyccatgttttagaccagaagtgctgcagaatctgaggcccggacgccgtttggtcttattaagggtcatgcctacagtgtaacgggaattgaccaggtagg

SEQ ID NO: 5582 - DNA, 201 bp, Homo sapiens
ctggaattagtaccatcacagtaattgctgcatatgagcaggaggtagaaaccagagtttgagaggctacctgaggtcaggctagtggaaagaaggtctgrtgcagacggtgggagaagccgggcagaggaaactcggaaattcacagcaggaagctccacaaagaagagcgtccatgtgagtgatccattgccctgcccc

SEQ ID NO: 5583 - DNA, 201 bp, Homo sapiens
gagactcaaccaagagtccatgaattgtgtccgaaaagccaagaggaacttccctaggaaacccctccctttcttgcccattgcagtgccctgacaaagaygaacacctgaacaaagacttcttcagataccacgcttctcgggccagaagcaagacgttcatcaacctgagagaagtctccgaccggttcaagctgcccc

SEQ ID NO: 5584 - DNA, 201 bp, Homo sapiens
gcacctggggcagcagaaggggctggaggttgtgaccgggccaggcatgtagctgggtctgatccagcaggggaggcttgacttagacggtgggtgtgackctgctctttccatgttttagaccagaagtgctgcagaatctgaggcccggacgccgtttggtcttattaagggtcatgcctacagtgtaacgggaattga

SEQ ID NO: 5585 - DNA, 201 bp, Homo sapiens
actagttaatgggtgcagcacaccaacatggcacaggtatacatatgtaacaaacctgcacgttgtgcacatgtaccctaaaacttaaagtataataaataaataaataaataaataaataaataaataaataaataaaaaataaaataaaataaaataaaaataaataaataaaacacaagttttaaccaagcatggtgg

SEQ ID NO: 5586 - DNA, 201 bp, Homo sapiens
cgcctgagagtcccccgcacactcgcccctgcaccacagattcacactctcacgctgcattcacaccaagggcagcagtcccactgggtctggggaccccmgctttgaggagtgaaacagtggcttcctcttctgagccctctcctcagctgcctgggagctccctcaaaggtgcagactcacctcggggctcggatacag

SEQ ID NO: 5587 - DNA, 201 bp, Homo sapiens
aatttcctttctttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaac

SEQ ID NO: 5588 - DNA, 201 bp, Homo sapiens
atttcctttctttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaaca

SEQ ID NO: 5589 - DNA, 201 bp, Homo sapiens
gatgcttcttttttatttttaaaaagtcgtatatgacatatcgataaataatcgtatatgataaaatgtatatgacataaattttaccatttttaagtgtkcagttgagtagcattaagtacatccatgttgttgtgcagctatcaccacgatctatctccagcactttttcatcttgcaaaactgaaattctgtccctat

SEQ ID NO: 5590 - DNA, 201 bp, Homo sapiens
ttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaac

SEQ ID NO: 5591 - DNA, 201 bp, Homo sapiens
tcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaact

SEQ ID NO: 5592 - DNA, 201 bp, Homo sapiens
ccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaactta

SEQ ID NO: 5593 - DNA, 201 bp, Homo sapiens
gcatagagtcgcagggagccggggggtagcgggccatagggaaatcacaagcattgccaggttccctgcagacctctgtggcttgggcatcatttgcagtrggactcagcattacacggtgcacgtctcagcagcccgtgggaccgtggggctggacggccctcctcctcagcaccaccttcttgtcaaacacagctgtgc

SEQ ID NO: 5594 - DNA, 201 bp, Homo sapiens
aaggtgatgggtggtgttaaatcatgcactctgtgcgtggagcccttcctcctggaatcctgactctgaagccctgtgtagcctctttccattcttcaccrgctctaggatgtacctcctgcaactctcttctctccccttacgtatgaattccccccttcttctgaatcattccccttagcactccaacactatcatttc

SEQ ID NO: 5595 - DNA, 201 bp, Homo sapiens
gtagaaatcaagaaagtgactgagagccaaggctggaataaaatttgtcttccactcatgcagcctccatgggtgatgggaggggcaggcgccatcccgaytccctgacttcgctgtgctgctggtgacatgtgagtagggttgaaggcaccgcatggccagcctgtcaggccaattatctgggtgtgagccacttaggat

SEQ ID NO: 5596 - DNA, 201 bp, Homo sapiens
aattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttata

SEQ ID NO: 5597 - DNA, 201 bp, Homo sapiens
attctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttatat

SEQ ID NO: 5598 - DNA, 201 bp, Homo sapiens
cacagaggtagaaatcaagaaagtgactgagagccaaggctggaataaaatttgtcttccactcatgcagcctccatgggtgatgggaggggcaggcgccrtcccgactccctgacttcgctgtgctgctggtgacatgtgagtagggttgaaggcaccgcatggccagcctgtcaggccaattatctgggtgtgagccac

SEQ ID NO: 5599 - DNA, 201 bp, Homo sapiens
agaggaaactcggaaattcacagcaggaagctccacaaagaagagcgtccatgtgagtgatccattgccctgcccctcttgaaggagcagccccaacaccwgggctgagcctgcccaaggtgatgggtggtgttaaatcatgcactctgtgcgtggagcccttcctcctggaatcctgactctgaagccctgtgtagcctc

SEQ ID NO: 5600 - DNA, 201 bp, Homo sapiens
ttctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttatatg

SEQ ID NO: 5601 - DNA, 201 bp, Homo sapiens
cacagctaccaggtcaccagacatggtgcagccgctgctgtattagccagaccccagcgtgagggcagggcacacaggcctgtgctttccaggctgtcatkgtccccatggaggctctcgtcccaccatcctctgctctggccttggctgccgccttctgagaaccaagaagcattggcagagatgagctgagatgggttg

SEQ ID NO: 5602 - DNA, 201 bp, Homo sapiens
gaagttcagtaggtcagtcaataaatcttgaaaatgcaagataatttaaagcaaatggagccaccacggagataccattatctgtaattaagctgagtctyggttggggctgcagggagatttctaaccaccctcccaagtactgccgaaccacttgggtggcagctatgaaatgtctgctcgcccagcccgtgctgacac

SEQ ID NO: 5603 - DNA, 201 bp, Homo sapiens
ccctgactctctcctctctctcttgccacccttgcaggctaaatgggagctatgaagctctgaagggaggcagcgccatcgaggccatggaagacttcacygggggtgtggcagagaccttccaaactaaagaggcccccgagaacttctatgagattctagagaaggctttgaagagaggctccctgctgggctgcttca

SEQ ID NO: 5604 - DNA, 201 bp, Homo sapiens
caatggtaaaagtcccagtctgagggcaggagagacggatgtcccagctcaggcacccaggaagagagagtgaattcccccttcctctgcctttttgttcwggtcaggtcttcacagatgagatgaggcccacctacactggggagggcaatctgttttactcaatcaacttaaatttcatgtcacccagaagcacccttg

SEQ ID NO: 5605 - DNA, 201 bp, Homo sapiens
gtgtgtccccacagctcctccagctctggtcccttgggaagtggaccaggtgactaagaaccagggatgtttgtgtgggtgcgtggcagggcctgcctgargctgttgctcgtccgctgcttgttgggctcctgaagccctttcctgccacatccatggcccctgagcttctggggaaatctgaagctagtctagaacttg

SEQ ID NO: 5606 - DNA, 201 bp, Homo sapiens
tctgccccttggtgagtgccccccacatcaggatgcaagcaaggcaacagaaactgtgtgccatctagtttctaaacataaaaaagatttattggggtcayttaaaaaggccaaaaatggttggcagaacagctcaccaaaaaaaaactgtatagatggtgttatggttagttttatgtgtcaacttgattgggccaaggg

SEQ ID NO: 5607 - DNA, 201 bp, Homo sapiens
tcccaggcatctaacccaggcccaccgcctagctgccccttccacacatgcgtccgcagaaccccctgtgactggcacgtgtgcacaccaattcccagaarcactgacccacagaggagtcggtcacacatccagacacctccccaatttatacccgatggctaatttgtgtttacttggagagtttctgagttttttcct

SEQ ID NO: 5608 - DNA, 201 bp, Homo sapiens
tccagacacctccccaatttatacccgatggctaatttgtgtttacttggagagtttctgagttttttccttttgtatttttctcctcattgggtgcgatytggtttaaaacaaaaacaaaaacagacctctcctgaacaaaacaaccaattgcaagataggagctgggaggcggtggcagctgcaggcacagttggtacg

SEQ ID NO: 5609 - DNA, 201 bp, Homo sapiens
aatcactgatgcagcaagatgctcaggatgacacagcaaagctgtaaataaatggctcccaaaaccactgtgcctaccctcctctttcaacccttttcttyttactcttagaggttaccttaggatcgctctcaggccaactgaaccagaaggaacgggtaggaggtgggtcactgcaggatacacagagaaactaccatg

SEQ ID NO: 5610 - DNA, 201 bp, Homo sapiens
ctgccagtttgctcactctcccttgctcatgttgtcccgtggttcccatgacactcccccagactccaataagtacaaaactggccagttaccggggccaytgtagcaatgacgggggtgggagaccatgggtctgagtgtcagaggtatgggagaaggattccagggggtttcaatcaccctctccccagaggatcccag

SEQ ID NO: 5611 - DNA, 201 bp, Homo sapiens
gggacaaagggcactgtttccaagtccagtgggtgggacccaagcccacctctgccccttggtgagtgccccccacatcaggatgcaagcaaggcaacagmaactgtgtgccatctagtttctaaacataaaaaagatttattggggtcacttaaaaaggccaaaaatggttggcagaacagctcaccaaaaaaaaactgt

SEQ ID NO: 5612 - DNA, 201 bp, Homo sapiens
tcctccctgttctacagtgagaggccgcagatcccctttgtgtggaaacgaccaggggtgagtggggcgagcaggggaaggagcatagatgaggccgaggytcagcagcccccgcaggaagtggaaacaggggtgctggggaggggccggctacgctcagtgcaactgaggtgcatcatcccagtctaccgtggaaagctt

SEQ ID NO: 5613 - DNA, 201 bp, Homo sapiens
actgatcctgggggacacccagactccacacagcaccaccctgacttcaagggagctgttggttaggaggagagatccttgaggggcacaaggggaagagwaagaaagaattgaatgaaagaggaggacaagaagccaaaggtatcactctgccagactcaagctcagcaaagcccagcagcctgccttgcccactccatg

SEQ ID NO: 5614 - DNA, 201 bp, Homo sapiens
agtacttagaaggtgcagatgcacctggtcttctgtagccacccaccttttgagtgacatcctctgaatgcgtggggagtaaagaacactgaagggagacyctgcccttcctcctcactggagccaaggtgtgagacgccgttggactctttgggattctttagaatgttagctatttgtgttggctcctttgtcctcctt

SEQ ID NO: 5615 - DNA, 201 bp, Homo sapiens
ggatcttcaagccatgagaatactatccccagagacagaagcaaggatggtcttgcttctacctccaagtgggacataaaagtggcaaaatagaggggagkcatactgtggttaaattaatcctgaaatcagcaggacagaattaaagccatcaaataagaaccaaagatgcccacgcttgccctctgtcccacccaggtc

SEQ ID NO: 5616 - DNA, 201 bp, Homo sapiens
gcaacctctgcctcccaggttcaagtgatactcctgcctcagcctcccaagcagctgagagtacaggcatgcgccaccacgcccgactcattttgtatctktagtagagatggggtttcaccgtgttggccaggctagtctcgaacccctgacctcagagaaaccacccaccttggcctcccaaagtgctggaattacagg

SEQ ID NO: 5617 - DNA, 201 bp, Homo sapiens
cagataaactttgaattttgaagtacaggggactttgagttagggggttacaagagaggagcaaaaactgcaggaagaaagctgagttctggaattagtamcatcacagtaattgctgcatatgagcaggaggtagaaaccagagtttgagaggctacctgaggtcaggctagtggaaagaaggtctggtgcagacggtgg

SEQ ID NO: 5618 - DNA, 201 bp, Homo sapiens
tgacagtccagggaggatgttcatattctgtgggtggctctgttcatacagtgattcaggaacccaaacgccttctattgtgtggctctgccatcttctarggtcacgtcatcatctgcacatagccagcagaagagaagaataaaataaaacattgaaaaagacactctcactttctaaaaatcttgactcagaagtaaa

SEQ ID NO: 5619 - DNA, 201 bp, Homo sapiens
gtcatgtttcttttttgtggatcattttgtgcaagtttctttggctgttttttagcctccaaagccaactccacctgaccaggagacagaggaggagcagyggtttcgggctctgtttgaacaagtcgctggtgaggtaggacatgccccacttccatctccccaccaggctgagggcctggacctgcttcctagcaaagg

SEQ ID NO: 5620 - DNA, 201 bp, Homo sapiens
atgtgttacctcccatggtgatgtttataacccagtgatatggtgaaaagctttatctgtagttgtgagtaactccagtaagcagtgtgcatatgcataartgcgtgtgtgtttgtgtgtgtgtgtgtatttggagtgtcggaatccctgaaatattacctagcatgtaactataggattctctctgatggtcactgacca

SEQ ID NO: 5621 - DNA, 201 bp, Homo sapiens
tgcttattttcttatcattcatctgtgcatgggatgctaggatgaagaaagttcagtaatagttccatgagcacctttgaggactactctttaccattcaytctgctagatgctgaagatgcctaagacttggctcctgcctctagggagatccaagtctagagagaaacccatttttagattcatatggactaatttctt

SEQ ID NO: 5622 - DNA, 201 bp, Homo sapiens
tttgagacggagttttgttcttattgcccaggctggagtgcagtggtgcgatctcgtctcactgcaacctctgcctcccaggttcaagtgatactcctgcytcagcctcccaagcagctgagagtacaggcatgcgccaccacgcccgactcattttgtatctttagtagagatggggtttcaccgtgttggccaggctag

SEQ ID NO: 5623 - DNA, 201 bp, Homo sapiens
caggcagagcctgagggcacacaggctcaagggtgattgaggtgaacagcaggaatcctcacagacacctgaaataaggagaatattgggtctagaagacrtaaaagctgtttttgtttattgttgtgtttaaatccccaacatgtgcttattttcttatcattcatctgtgcatgggatgctaggatgaagaaagttcag

SEQ ID NO: 5624 - DNA, 201 bp, Homo sapiens
taagcacagagacacccatccctccccaaccccaccagtggaatcaggaatttacatctgtgatgagaggcaggagttagggatgcagcttcaaaaggtgrtctttaggccaggcacggtggctcatgcctgtaatcccagcactttgggaggccgaggcaggaggatcacctgaagtcaggagtttgagaccagcctggc

SEQ ID NO: 5625 - DNA, 201 bp, Homo sapiens
ccgaagagttgatgttacttgaatttttacacatccaaaatataatttatgccaaatgcatgaggataaaacattctgactgctacagtttctggttagtygataactagaagtcttttactttcactctctctcctctaaaacccttctcaaatgcattggcccttgtccctgctcccaggcagagcctgagggcacaca

SEQ ID NO: 5626 - DNA, 201 bp, Homo sapiens
gagaatcacttaaaacccaggaggcagaggttgcagtgagccgagatcatgccattgcactccagcctgtgccacagagtgagactccgtctaaaaaaaawggtggtttttttggttctgattcaactttgtaatcttttaaaatgcaccccctccccagtgcctaccactcaataggctgaatggtctccaacagatatg

SEQ ID NO: 5627 - DNA, 201 bp, Homo sapiens
attttgcttcctctcccccctacaaggaactcacctgccctgaacctttcaaattaaatgagcccctttaatggtgagccacaagccacatcttggactcygaagagttgatgttacttgaatttttacacatccaaaatataatttatgccaaatgcatgaggataaaacattctgactgctacagtttctggttagtcg

SEQ ID NO: 5628 - DNA, 201 bp, Homo sapiens
tcctaggtctccctagaagtcaaggagttaagttaacttctagggaatacaccatgcttctttgtaaagccaattgaacctcttttctttgtaaattagtsttaggtatttctttatagcagtacaagaacagcctaatacagaaaattggtacagaagagtggggcattgttataaagataactgaaaatgtggaagtga

SEQ ID NO: 5629 - DNA, 201 bp, Homo sapiens
cgttggactctttgggattctttagaatgttagctatttgtgttggctcctttgtcctccttcaccatccatagatgacttgcagattgctcactcaagcrggcatgtgatgtttctaggttagatcttctacgtattccacgtaacaacagaaacctctcatcatcttggtttgcttgattttgcttcctctccccccta

SEQ ID NO: 5630 - DNA, 201 bp, Homo sapiens
tagggtatctggaagaagaaatgtctaagcagcaaagcattcaggatgtgacctggctgcttctaacaacctatactcagatatgggagcaaagatatgasttaaagctggaatatatacatttaaaagggaagcagggcataaaaatttggaaaatttgcagcctggctatatagcagagaaagaaaaagctttttcgag

SEQ ID NO: 5631 - DNA, 201 bp, Homo sapiens
cctatgattttcttgataacatttcttttctctggcttatttattgtaagaatacagtatataatataaataattataaaacatgttaattggttctttaygttatcgataagacttctggtcaatggtaggctattcggagttcagctttagggaatacaagattttttgacaatgcaggagggttggcaccccaacccc

SEQ ID NO: 5632 - DNA, 201 bp, Homo sapiens
aagcctgcaggcacacagagtgcaagactgaatgaggcttggcagcctccacctagatttcagaggatgtatggaaaagcctgcatgcctaggcaaaagcytgctgcagggacagagccctcacagagaacttctactagggctatgcagatggggaaatgtgaggttcaaggtctcgcacagagtccccactggggtact

SEQ ID NO: 5633 - DNA, 201 bp, Homo sapiens
gataacttgcttcccgtcttccttccacaccacccagccagggcaagccctgggagatgcttcaggcttagttagaaaagctctgaaagcagggtgccccrgtggcctccctaggtccctgactctctcctctctctcttgccacccttgcaggctaaatgggagctatgaagctctgaagggaggcagcgccatcgaggc

SEQ ID NO: 5634 - DNA, 201 bp, Homo sapiens
ggtactgcctagtggaactgtgggaaggcggccatcatcctccagacccaagaatggtggatccactggcagcttgcaccttgagcctggaaaagccacaggtactcaacaacccatgacagcagccaaagtcacagggacagagcttcccaaggccttgggatcccaccctttgtaccagtgttccctggatgtaggaca

SEQ ID NO: 5635 - DNA, 201 bp, Homo sapiens
actcccattgtattttggaagtataaaatggaatttgtatatcttggaacttgattttgatttgacaggctcataggtgatgggacttgccttatctcagrtgagactttggactttggaattttgagttaatgctggaatgacttaagactttgggggttattgggaaggcataattatattttgcagtgtgagaaggac

SEQ ID NO: 5636 - DNA, 201 bp, Homo sapiens
taatgttagaatgtttcatcactccaacaagaaaccctttacccattaacagtgttaaccctgtacccatttcccccagccccaggcaaccactcatctaytttctctatagattctatttacatattctgaatattttatataaaaggaatcataggccgggtgcggtggctcacgcctgtaatcccagcactttgggag

SEQ ID NO: 5637 - DNA, 201 bp, Homo sapiens
acttgcttcatgtcactgctaaacatcctaggggagccccgtgcatagcccacgcacatggcctgcacctggggcagcagaaggggctggaggttgtgacygggccaggcatgtagctgggtctgatccagcaggggaggcttgacttagacggtgggtgtgactctgctctttccatgttttagaccagaagtgctgcag

SEQ ID NO: 5638 - DNA, 201 bp, Homo sapiens
cttctatgagattctagagaaggctttgaagagaggctccctgctgggctgcttcattgatgtaagttgctcatgggctcccattccaggcactatgctgrggctgcatagtgcattccaggcactatgctggggctgtaccaggtaccccagccacacccaaggaggggcataactcttgggggcagtgtttattcctgc

SEQ ID NO: 5639 - DNA, 201 bp, Homo sapiens
gggggtgtggcagagaccttccaaactaaagaggcccccgagaacttctatgagattctagagaaggctttgaagagaggctccctgctgggctgcttcaytgatgtaagttgctcatgggctcccattccaggcactatgctggggctgcatagtgcattccaggcactatgctggggctgtaccaggtaccccagccac

SEQ ID NO: 5640 - DNA, 201 bp, Homo sapiens
catgcatacatgtgctcaaacacacacgtgtgtagaagcacttgcaaacacatgcatgcacacatacatgcacacacatgcacacatgtgagcaaacacaygctttcacacatgcaatgtataaataaaccacaaacagtgcacatacctgtcatgcctgcctgtatgcacatgtatacacatgtgtgcgcacatgcattc

SEQ ID NO: 5641 - DNA, 201 bp, Homo sapiens
cctgccccctgcatcgcctgcggctttgatgggttgaccctgagtctttcagctgatgtcaatggttagtgctgggtggaatactcagcttgtaacttggwggacaaagcccaggtgccctaccttggaacccgtgtgtgattttcaaagctgtctatgggtagcttggtcagaggggaaaaaagcaacaggatcaacatt

SEQ ID NO: 5642 - DNA, 201 bp, Homo sapiens
tggagcagggcttggcctctgggggacccagtgaacctagagcagaggggatttaaaatggtgcagcaggctgcaggctataggctagaggaattgtattyggacaggggagaagggaaaacagcatcatgctattccgatgcttacgggagtaccaccgtgcttccacccaagacgaaaaggaagacaaaagggagaccg

SEQ ID NO: 5643 - DNA, 201 bp, Homo sapiens
ttcccagccagcaattcctccctgttctacagtgagaggccgcagatcccctttgtgtggaaacgaccaggggtgagtggggcgagcaggggaaggagcayagatgaggccgaggttcagcagcccccgcaggaagtggaaacaggggtgctggggaggggccggctacgctcagtgcaactgaggtgcatcatcccagtc

SEQ ID NO: 5644 - DNA, 201 bp, Homo sapiens
actctgccgaccacaacgagttctggagcgccttgctggaaaaagcctacgccaagtgagtgacagcttccccagctcaggcagcctcccgacaggagtctctacactagtctttgtagtgagcatctaagggctgggaaaaaatcagggctctgggtttgcaggtgaggctcggcaggacccaaccctctcagggctcaa

SEQ ID NO: 5645 - DNA, 201 bp, Homo sapiens
catccccttctgacacagagttttcctatttgctgtgaaatagcaatgaaaattgtgatttatggcttccattttgcaggagactgctggctattagccgycatcgcctcccttacgcttaatcaaaaagcactggccagagtcatcccccaggaccaaagctttggccctggttatgccgggatattccatttccaggta

SEQ ID NO: 5646 - DNA, 201 bp, Homo sapiens
tgcaggtgaggctcggcaggacccaaccctctcagggctcaagcggggttggaggtggttttcctgtcgtagcctagatgtgcccatctttgggagcagtsgctacattcatgaccctttttctccctgggccatgaatctggcctttggaagagctgggaaggcaagcggaggggaattctggctgtgccgacagcactt

SEQ ID NO: 5647 - DNA, 201 bp, Homo sapiens
acccaccttttgagtgacatcctctgaatgcgtggggagtaaagaacactgaagggagaccctgcccttcctcctcactggagccaaggtgtgagacgccrttggactctttgggattctttagaatgttagctatttgtgttggctcctttgtcctccttcaccatccatagatgacttgcagattgctcactcaagcag

SEQ ID NO: 5648 - DNA, 201 bp, Homo sapiens
cgaaccacttgggtggcagctatgaaatgtctgctcgcccagcccgtgctgacactgatgtatgcagtcttggtcctctggaaagggagttgctggaattyacagagctgatgcatcaggcagccatatgtctgaaacccaagtaagcatgtcctataacagtgccaagaaggcaacagctgtttatgatagacgggcaga

SEQ ID NO: 5649 - DNA, 201 bp, Homo sapiens
aggcaagcggaggggaattctggctgtgccgacagcacttagtgcttcacacttccctcggacactggcatggctcaaacatctgggctattacgcacgtkgatatagagacatcaattgtccgtcctacgggatgcttcttttttatttttaaaaagtcgtatatgacatatcgataaataatcgtatatgataaaatgt

SEQ ID NO: 5650 - DNA, 201 bp, Homo sapiens
gatgtgcagtgcccctcaactttgagatcgtagcctataaagggaaaatgggccattgtctcccattttctgggactcacagaggtagaaatcaagaaagkgactgagagccaaggctggaataaaatttgtcttccactcatgcagcctccatgggtgatgggaggggcaggcgccatcccgactccctgacttcgctgt

SEQ ID NO: 5651 - DNA, 201 bp, Homo sapiens
gctgagtctgggttggggctgcagggagatttctaaccaccctcccaagtactgccgaaccacttgggtggcagctatgaaatgtctgctcgcccagcccrtgctgacactgatgtatgcagtcttggtcctctggaaagggagttgctggaattcacagagctgatgcatcaggcagccatatgtctgaaacccaagtaa

SEQ ID NO: 5652 - DNA, 201 bp, Homo sapiens
ctccaataagtacaaaactggccagttaccggggccactgtagcaatgacgggggtgggagaccatgggtctgagtgtcagaggtatgggagaaggattcyagggggtttcaatcaccctctccccagaggatcccagtggacccatctgctcacagggaggtccatgggccagcagcagcataggcatcacttaggagag

SEQ ID NO: 5653 - DNA, 201 bp, Homo sapiens
ccagaaagggccatattacaatgtcccaagcccagtgacatacggtgctttccagaaatgtgaactcagaaactgccaagctgagtgtgatgggcttttakgttctgatgacgttgatgttgtctactgaaaacaagtgaatctggataaaggtgattcggataaatggatcctcccagatatctgcttacacaggcggca

SEQ ID NO: 5654 - DNA, 201 bp, Homo sapiens
tcggacactggcatggctcaaacatctgggctattacgcacgttgatatagagacatcaattgtccgtcctacgggatgcttcttttttatttttaaaaartcgtatatgacatatcgataaataatcgtatatgataaaatgtatatgacataaattttaccatttttaagtgtgcagttgagtagcattaagtacatcc

SEQ ID NO: 5655 - DNA, 201 bp, Homo sapiens
acagccagaaagggccatattacaatgtcccaagcccagtgacatacggtgctttccagaaatgtgaactcagaaactgccaagctgagtgtgatgggctyttaggttctgatgacgttgatgttgtctactgaaaacaagtgaatctggataaaggtgattcggataaatggatcctcccagatatctgcttacacaggc

SEQ ID NO: 5656 - DNA, 201 bp, Homo sapiens
ctgtttgaggatgcagacttcccagccagcaattcctccctgttctacagtgagaggccgcagatcccctttgtgtggaaacgaccaggggtgagtggggygagcaggggaaggagcatagatgaggccgaggttcagcagcccccgcaggaagtggaaacaggggtgctggggaggggccggctacgctcagtgcaactg

SEQ ID NO: 5657 - DNA, 201 bp, Homo sapiens
gtgacacctctcagaaagccagaaccagggcgattcggaattagctttcccgatgttcagccctggcgagtctctcttgcctgtgtcaaacagccagaaarggccatattacaatgtcccaagcccagtgacatacggtgctttccagaaatgtgaactcagaaactgccaagctgagtgtgatgggcttttaggttctga

SEQ ID NO: 5658 - DNA, 201 bp, Homo sapiens
tctgtgctccagctaaggctgggggtggcttgtactctgctggtgacacctctcagaaagccagaaccagggcgattcggaattagctttcccgatgttcrgccctggcgagtctctcttgcctgtgtcaaacagccagaaagggccatattacaatgtcccaagcccagtgacatacggtgctttccagaaatgtgaact

SEQ ID NO: 5659 - DNA, 201 bp, Homo sapiens
aaagggagaccgacttcttttggaaggcccagtccaactgtggcctctgcggcccctagagggtagctcccccgggctggctgtcacccatttactgccaycagcgatgcctttcaggcacgctccttctcaaggcttctgctctccaccctttagaaccttttccttcggtttgatgctgacaagtccggcaccatgtct

SEQ ID NO: 5660 - DNA, 201 bp, Homo sapiens
atgttataaagaataacaagaaaatgaacagccgtgatctgttgccacccacaataagaactagaacatctggtcatgtagagtgctcacacctgtaatcrcagcgctttgggagggggaggtgggaagatctcttgagcccaggagttttagactagcctgggcaacatagcaagaccacatctctatcaaaaaaaaaaa

SEQ ID NO: 5661 - DNA, 201 bp, Homo sapiens
ggacacaagatgagaggagaagcagggtgctgagaagcctgaggaagacaattcaaagcagaggtctctcggggaaggcggcgcagcttgagctccccacrtggcgtccgcccagacactgctggaaccttccacctccagcccaggcccctcctcagtcctggtgcctggaaaagtgggaagaggtgggaaaaatccttc

SEQ ID NO: 5662 - DNA, 201 bp, Homo sapiens
ggcccggcttcctccctccctccctccctccctccctttgtttaggtctgtgctcctctgcttcccccagagacgcctcccctgctgactgctgtagctasccttgccccatcccaccccttccctctccatcctcgctcttttctctcctggtttatggtttgtctcttcctcaaatgcaatttgcaaaactctcctgaa

SEQ ID NO: 5663 - DNA, 201 bp, Homo sapiens
acaactcacttactttttgtcaaagttagaattctccaagataaaagctggacgcacaaaccagcatggagggcatctttgtctcccccttcagaagtctyccctcctgggaccagggccaccaaggcctgcccagcgactctagagtcccagatctctgctccaaggggctgtcttccttagtattatctcctctggcat

SEQ ID NO: 5664 - DNA, 201 bp, Homo sapiens
atggcttccattttgcaggagactgctggctattagccgccatcgcctcccttacgcttaatcaaaaagcactggccagagtcatcccccaggaccaaagmtttggccctggttatgccgggatattccatttccaggtaagagggagccctgggccagtgggtttacctctctggggcccggcatgagggcaggtgcatt

SEQ ID NO: 5665 - DNA, 201 bp, Homo sapiens
gcggacaggaacaagatgatttaatgaataagtgaatgatttaatgaatgagtgaatggatgatgccctcactcttgccctcctgtgcatcgtgtctctcmgctttgctgcaggatggcatttcaggacttcaaggcccactttgataaagtggagatctgcaacctcactcccgatgccctggaggaagacgcgatccac

SEQ ID NO: 5666 - DNA, 201 bp, Homo sapiens
ataaacaggcaaggcagggagattaggggaccacaggatcggatggagaaaatgggggctcatgtgactgcttaaagcacagcaggaaggtggctgagcgyagccctgggcgggacagagcatggtgaggggggaaggcagtggtgacctccctgctccaggtgctatctggagcatgctgggtcagacccagcaagacag

SEQ ID NO: 5667 - DNA, 201 bp, Homo sapiens
catccttagccagcagaatagtcttcttcacagaaaataacccaaagctgggggacccccatgctgaaattggatcagaatcaagatgcacaagactgccyagtggtgggggtggggagcttttgaagggacttgggggtcttcttgccactttgggatcccatccaagggaacagagttctgtttttgtgaactttccgg

SEQ ID NO: 5668 - DNA, 201 bp, Homo sapiens
ctagtggtgggggtggggagcttttgaagggacttgggggtcttcttgccactttgggatcccatccaagggaacagagttctgtttttgtgaactttccrggaccacccccattccacttctgccgtttcccctcttcagagatttgtggtttaatcattaaaaccacttccccagggccccaaacctgtgcacccaggc

SEQ ID NO: 5669 - DNA, 201 bp, Homo sapiens
attctccaagataaaagctggacgcacaaaccagcatggagggcatctttgtctcccccttcagaagtctcccctcctgggaccagggccaccaaggcctscccagcgactctagagtcccagatctctgctccaaggggctgtcttccttagtattatctcctctggcattgccccaaacgctgggtgaggccttcatcc

SEQ ID NO: 5670 - DNA, 201 bp, Homo sapiens
tgagccaagattgtgccactgcactccagcctgggcgacagagtgagactccatcaaaagaaagaaggaaagaaggaaaagaaagaaaagaaagaaaaatragaaagaaagaagaaagaaagaaagaaagaaagaaagaaagaaagaaagaaagaaagaaagaaagaaagaaagaaagaaagaaaggaaaaacaagagaga

SEQ ID NO: 5671 - DNA, 201 bp, Homo sapiens
tactgtgttgctgtcgttcccacagactcattttcagaatctgttctgccttttcctttgtctgcaactgaagattgtccctttggtctggtcctcattcycgtacccctatctgtttcttatttaggggagttaggagctttacatcatatcttacagatttctgtaaaatcaggaacaaaagggctgaggatgagcatg

SEQ ID NO: 5672 - DNA, 201 bp, Homo sapiens
tgccactgcactccagcctgggcgacagagtgagactccatcaaaagaaagaaggaaagaaggaaaagaaagaaaagaaagaaaaataagaaagaaagaaraaagaaagaaagaaagaaagaaagaaagaaagaaagaaagaaagaaagaaagaaagaaagaaagaaagaaaggaaaaacaagagagacccctaggtccac

SEQ ID NO: 5673 - DNA, 201 bp, Homo sapiens
ggaaaagaaagaaaagaaagaaaaataagaaagaaagaagaaagaaagaaagaaagaaagaaagaaagaaagaaagaaagaaagaaagaaagaaagaaagwaagaaagaaaggaaaaacaagagagacccctaggtccacctttatttatcatttactttaaggtaaatgataagtaatgtcactaaaaaacatgaggaag

SEQ ID NO: 5674 - DNA, 201 bp, Homo sapiens
aaagaaagaaaaataagaaagaaagaagaaagaaagaaagaaagaaagaaagaaagaaagaaagaaagaaagaaagaaagaaagaaagaaagaaagaaaggaaaaacaagagagacccctaggtccacctttatttatcatttactttaaggtaaatgataagtaatgtcactaaaaaacatgaggaagtgtgatggctgc

SEQ ID NO: 5675 - DNA, 201 bp, Homo sapiens
caccttctaaaagagccttcatgagaaaatgttcctcacgctacaggacgcagcttgtgcacaccgcctcaggagggtgacatggggctgggcacacaggstcctggcttctttcctgctatttttgtcatgtttcttttttgtggatcattttgtgcaagtttctttggctgttttttagcctccaaagccaactccacc

SEQ ID NO: 5676 - DNA, 201 bp, Homo sapiens
tgataacttgcttcccgtcttccttccacaccacccagccagggcaagccctgggagatgcttcaggcttagttagaaaagctctgaaagcagggtgcccyagtggcctccctaggtccctgactctctcctctctctcttgccacccttgcaggctaaatgggagctatgaagctctgaagggaggcagcgccatcgagg

SEQ ID NO: 5677 - DNA, 201 bp, Homo sapiens
gtgattttcaaagctgtctatgggtagcttggtcagaggggaaaaaagcaacaggatcaacatttacaaacagggcctggagctcccatgtagctgactcrcatcatttctgtctttttcctgggcaacagttctggcagcacagtgagtggctggacgtggtgatcgatgaccgcctgcccaccttcagggaccgcttgg

SEQ ID NO: 5678 - DNA, 201 bp, Homo sapiens
tgccgaccacaacgagttctggagcgccttgctggaaaaagcctacgccaagtgagtgacagcttccccagctcaggcagcctcccgacaggagtctctayactagtctttgtagtgagcatctaagggctgggaaaaaatcagggctctgggtttgcaggtgaggctcggcaggacccaaccctctcagggctcaagcgg

SEQ ID NO: 5679 - DNA, 201 bp, Homo sapiens
gacgtggtgtggggagaatcgcccctcatccccctcctctagccccaaacatcaggattctggccaaggctggcagccagcactgccgtgcaggctccagrgactctgtgctctgtgtctgacctgcctgctcctctgctggaattaggaagaagcagaaagaccctgggtggatttctgaacaatcctgtgaacacctcc

SEQ ID NO: 5680 - DNA, 201 bp, Homo sapiens
gctccacaggtccagctaataaagtccttctagtctcaccttctaaaagagccttcatgagaaaatgttcctcacgctacaggacgcagcttgtgcacacygcctcaggagggtgacatggggctgggcacacaggctcctggcttctttcctgctatttttgtcatgtttcttttttgtggatcattttgtgcaagtttc

SEQ ID NO: 5681 - DNA, 201 bp, Homo sapiens
acacctgactaacactaccttagccaggtgatcaaggccagcatcagctgtggtaaggcatgtggacggcaggtactcttgatatcatgagatgagagggsagctttacctctccggtcttccttccactaaccaatagccccactcttttttttattattatttacttttttttggagacagggtcttgctctctcaccc

SEQ ID NO: 5682 - DNA, 201 bp, Homo sapiens
tcccccatgtatgccatattctagatacaatgtagacttttcaaaaggtttacattcaggtggtccttctccaggagatcctccctgccgctgcccacctstccccctcttcctctgcctcccttcccctcgaccccgtagtcctccattgctatccaataggaaatcattctactggctcctttgtttttcaaagttttg

SEQ ID NO: 5683 - DNA, 201 bp, Homo sapiens
ggggcagcagaaggggctggaggttgtgaccgggccaggcatgtagctgggtctgatccagcaggggaggcttgacttagacggtgggtgtgactctgctytttccatgttttagaccagaagtgctgcagaatctgaggcccggacgccgtttggtcttattaagggtcatgcctacagtgtaacgggaattgaccaggt

SEQ ID NO: 5684 - DNA, 201 bp, Homo sapiens
cacctggcctgtatccttcccagctctctatctgctcgtacaaacaggcacacacttccacacacaaacatcaaggtcagttggtttgattttactgaaaygggatcttcctatctagttttctgaaatttgttttttttttttcatttcatgtactatgaaaaaaatagcagatagaagtctaatgatattttttaaaat

SEQ ID NO: 5685 - DNA, 201 bp, Homo sapiens
aacctgagtgcacctcaagtcactcaaattgggtcctgcattttaggacttaatccaactgggctgggtttacctttgttctatctatgaaagacagagaragtgagagagcgagagactttcttttaaaaaataccagtgaaatcagcctagagaacaaaccactgcaagcttgtgtggaccctgacttatttctagctg

SEQ ID NO: 5686 - DNA, 201 bp, Homo sapiens
tgtatccttcccagctctctatctgctcgtacaaacaggcacacacttccacacacaaacatcaaggtcagttggtttgattttactgaaacgggatcttyctatctagttttctgaaatttgttttttttttttcatttcatgtactatgaaaaaaatagcagatagaagtctaatgatattttttaaaattttctctat

SEQ ID NO: 5687 - DNA, 201 bp, Homo sapiens
aggacccaagaggcacggggctgggggaacaacactgcttcggcctctgcttcctcactccctctgaatggagtccagtggcctcaagcccctgcacctcygttcctctagagtcagacatgcctgtgatgtggggctcacagccccggagtttacagaggaaagtgacacccagcagcgttggtcgggctctcctacacc

SEQ ID NO: 5688 - DNA, 201 bp, Homo sapiens
tgctcgtacaaacaggcacacacttccacacacaaacatcaaggtcagttggtttgattttactgaaacgggatcttcctatctagttttctgaaatttgttttttttttttcatttcatgtactatgaaaaaaatagcagatagaagtctaatgatattttttaaaattttctctatgcatacaaacacacacacttata

SEQ ID NO: 5689 - DNA, 201 bp, Homo sapiens
acgtgtgagacctggcagaggacaggccagcatttgggaggtccttacttctgccgggcctggggttttggcgcatctaaaaacaccccgtgttcttcagmaattctcctggccaagctttcttgagtattttagacactaatgccacacatagctctccctgggcaggcgcccctggtgtctgtcactcctccaggttgt

SEQ ID NO: 5690 - DNA, 201 bp, Homo sapiens
caggcacattctgcaacaagcccagaatgtctaagctggtgacagatgaggatgcagccgtgagaagttaaatggcccaccctgaaccctactgctgagcsgggcaggctattcctgggactctattgaggcccactgacatggtcctggtttgcattgtccttctgggctcagctcagagccacctgcaaactcctgcgc

SEQ ID NO: 5691 - DNA, 201 bp, Homo sapiens
gcattgcttgccagggctatcccctggcaggggctgggcaatcaagacagggagggcttgggggactcctgggtttcccttcgggcaggcacattctgcarcaagcccagaatgtctaagctggtgacagatgaggatgcagccgtgagaagttaaatggcccaccctgaaccctactgctgagcggggcaggctattcct

SEQ ID NO: 5692 - DNA, 201 bp, Homo sapiens
gagcaacacaggcttgaacttatatggggattttcttccatctctaccacccctgagacagcaagaccaactcctcctcctccttctcagcctactcaacrtgaagataataaggatgaagacctttacaatgacccagttccacttaataaatagtaaatgtatttcctcttccctatgattttcttgataacatttctt

SEQ ID NO: 5693 - DNA, 201 bp, Homo sapiens
ggtagcgggccatagggaaatcacaagcattgccaggttccctgcagacctctgtggcttgggcatcatttgcagtgggactcagcattacacggtgcacrtctcagcagcccgtgggaccgtggggctggacggccctcctcctcagcaccaccttcttgtcaaacacagctgtgcttggggagggtgggcagagcacaa

SEQ ID NO: 5694 - DNA, 201 bp, Homo sapiens
ttcttccatctctaccacccctgagacagcaagaccaactcctcctcctccttctcagcctactcaacatgaagataataaggatgaagacctttacaatkacccagttccacttaataaatagtaaatgtatttcctcttccctatgattttcttgataacatttcttttctctggcttatttattgtaagaatacagta

SEQ ID NO: 5695 - DNA, 201 bp, Homo sapiens
ccttcactcctctgcaggccccggcccagttaactcaccacccctgcagggtgagccagaacgtgcctcgctgccacaggattggctgttacctctcccgrgaccggcccggcttcctccctccctccctccctccctccctttgtttaggtctgtgctcctctgcttcccccagagacgcctcccctgctgactgctgta

SEQ ID NO: 5696 - DNA, 201 bp, Homo sapiens
ttttcctggctgagttggcctcacctgcaatcactttcctaaaaaggcctgtgcacctttcattacagtagctctcatactatatacactgtgcccaggarggaggacagagaagggagaaaaaaaccatctcatataatcacgttgccccaagtcaccatgctgtaataaacaagctgttgggaaggaggaggcagggtg

SEQ ID NO: 5697 - DNA, 201 bp, Homo sapiens
ataaatagtatctcaaaaatattagctattttgttataatcactcccacagaaactaggcatttttcttctctagttttgtctttcaacttcagcatgtargacacatgtaataactatacctcctttgatcaatccaagattccaaagaaagatgtgcacacacaaattattcttttatgaaaataagaggaagctgggc

SEQ ID NO: 5698 - DNA, 201 bp, Homo sapiens
tcatcccccaggaccaaagctttggccctggttatgccgggatattccatttccaggtaagagggagccctgggccagtgggtttacctctctggggcccrgcatgagggcaggtgcatttccacactgcctggtaaccctagaaaaaaatgtcatcagatctgtgtgacatatggtcctaaaccatgctaaagccacatt

SEQ ID NO: 5699 - DNA, 201 bp, Homo sapiens
agccaattacgtattattacggtgagccaaatggggatactattggtacttagctcacagaattattgtaatggcttaattgattacttcataaatagtakctcaaaaatattagctattttgttataatcactcccacagaaactaggcatttttcttctctagttttgtctttcaacttcagcatgtaggacacatgta

SEQ ID NO: 5700 - DNA, 201 bp, Homo sapiens
acgcttaatcaaaaagcactggccagagtcatcccccaggaccaaagctttggccctggttatgccgggatattccatttccaggtaagagggagccctgrgccagtgggtttacctctctggggcccggcatgagggcaggtgcatttccacactgcctggtaaccctagaaaaaaatgtcatcagatctgtgtgacata

SEQ ID NO: 5701 - DNA, 201 bp, Homo sapiens
tggagcagcttccccacaggctccactggaaggccctttggtcgctgggaaacaaacttggtaaaggaattgtctttaaaaggatgcctttcccccttctytcctatcaggggtgttccaggctctcagtacaaagaacaaggagttcattcatctcaatataaatgaggtatggccaatccagaccctctgctcagggac

SEQ ID NO: 5702 - DNA, 201 bp, Homo sapiens
catggcgagagggaggttgagtcactgggacaggcaagcaactgcagcatggggtccctgaggacccaagaggcacggggctgggggaacaacactgcttyggcctctgcttcctcactccctctgaatggagtccagtggcctcaagcccctgcacctccgttcctctagagtcagacatgcctgtgatgtggggctcac

SEQ ID NO: 5703 - DNA, 201 bp, Homo sapiens
aggaaatcgtgaaaaacccagaattcattcttggaggggccaccaggactgatatctgccagggagagctgggtgagtgtaagtggatggagcatggcgaragggaggttgagtcactgggacaggcaagcaactgcagcatggggtccctgaggacccaagaggcacggggctgggggaacaacactgcttcggcctctg

SEQ ID NO: 5704 - DNA, 201 bp, Homo sapiens
ccaggaaatcgtgaaaaacccagaattcattcttggaggggccaccaggactgatatctgccagggagagctgggtgagtgtaagtggatggagcatggcragagggaggttgagtcactgggacaggcaagcaactgcagcatggggtccctgaggacccaagaggcacggggctgggggaacaacactgcttcggcctc

SEQ ID NO: 5705 - DNA, 201 bp, Homo sapiens
gcaggggaaggagcatagatgaggccgaggttcagcagcccccgcaggaagtggaaacaggggtgctggggaggggccggctacgctcagtgcaactgagktgcatcatcccagtctaccgtggaaagctttgcagtttggaggcagaaaataatgtacaggcctgggatgctctgcggtggggacccggggcatctggtt

SEQ ID NO: 5706 - DNA, 201 bp, Homo sapiens
atccatggcccctgagcttctggggaaatctgaagctagtctagaacttggttaaaactgagccagtgtttgtcttcagtccagacacagctaccaggtcrccagacatggtgcagccgctgctgtattagccagaccccagcgtgagggcagggcacacaggcctgtgctttccaggctgtcatggtccccatggaggct

SEQ ID NO: 5707 - DNA, 201 bp, Homo sapiens
aactttccagtggagacacctgactaacactaccttagccaggtgatcaaggccagcatcagctgtggtaaggcatgtggacggcaggtactcttgatatsatgagatgagaggggagctttacctctccggtcttccttccactaaccaatagccccactcttttttttattattatttacttttttttggagacagggt

SEQ ID NO: 5708 - DNA, 201 bp, Homo sapiens
gctgggtgagtgtaagtggatggagcatggcgagagggaggttgagtcactgggacaggcaagcaactgcagcatggggtccctgaggacccaagaggcayggggctgggggaacaacactgcttcggcctctgcttcctcactccctctgaatggagtccagtggcctcaagcccctgcacctccgttcctctagagtca

SEQ ID NO: 5709 - DNA, 201 bp, Homo sapiens
cctggtgcctggaaaagtgggaagaggtgggaaaaatccttcactcctctgcaggccccggcccagttaactcaccacccctgcagggtgagccagaacgkgcctcgctgccacaggattggctgttacctctcccgagaccggcccggcttcctccctccctccctccctccctccctttgtttaggtctgtgctcctct

SEQ ID NO: 5710 - DNA, 201 bp, Homo sapiens
tggcaaagatagaccacagagagccatggtctgatgtgtgtggacccatgggcctgtgcggttagctaaggagcagaatgtgccagcctcccctgcagcaygtttcttagcatcgcctttctttatacattcacagtgcctctgtgggaggatgatgggctggggcaggtttgtgccttgtgtttgaggaaaggttcaatt

SEQ ID NO: 5711 - DNA, 201 bp, Homo sapiens
atgccaggtactgcctgtgggcaacctgagcagatggcaggtcttctctctgctgcccaggaggtgggcctctgagcccagttggtgattcttaaggtcayggcccttggagtggtggcaccagggttcagacccaggactcacttcctgacaccagggccctcattttaaaccactgtgaacattggtagaaacttttta

SEQ ID NO: 5712 - DNA, 201 bp, Homo sapiens
ccatcagcgatgcctttcaggcacgctccttctcaaggcttctgctctccaccctttagaaccttttccttcggtttgatgctgacaagtccggcaccatrtctacctatgaactacggactgcactgaaagctgcaggtaaagaaaagactggagtacaggtggctgactgcatgccaggtactgcctgtgggcaacctg

SEQ ID NO: 5713 - DNA, 201 bp, Homo sapiens
gtctagcacacagaaggtttccagtacattacagctattgtcacattattactattactgatactattattatcatcattacaatgattattagctctgartctcatcttacatatgagtagcaaaggactcatcataactacctcctcactatctcccaacattaaaataatgttgatgattaaaaacaattttttttaa

SEQ ID NO: 5714 - DNA, 201 bp, Homo sapiens
cggagttggggtgaaagctcccaggcaccttcctcaccgaagccacgctgtgattgtttttggttctctgcatatggccaattgcagtgtgaggtcacggyactggcagatcacgtggggttgcactttacagacaggattagtaggtcatgctctgctaagtaagaaaaaggacatttccaaactaaaaaagcagaagtt

SEQ ID NO: 5715 - DNA, 201 bp, Homo sapiens
tacacatccaaaatataatttatgccaaatgcatgaggataaaacattctgactgctacagtttctggttagtcgataactagaagtcttttactttcacyctctctcctctaaaacccttctcaaatgcattggcccttgtccctgctcccaggcagagcctgagggcacacaggctcaagggtgattgaggtgaacagc

SEQ ID NO: 5716 - DNA, 201 bp, Homo sapiens
gaaagtgactgagagccaaggctggaataaaatttgtcttccactcatgcagcctccatgggtgatgggaggggcaggcgccatcccgactccctgacttygctgtgctgctggtgacatgtgagtagggttgaaggcaccgcatggccagcctgtcaggccaattatctgggtgtgagccacttaggataatggctccaa

SEQ ID NO: 5717 - DNA, 201 bp, Homo sapiens
cgaaaaggaagacaaaagggagaccgacttcttttggaaggcccagtccaactgtggcctctgcggcccctagagggtagctcccccgggctggctgtcayccatttactgccatcagcgatgcctttcaggcacgctccttctcaaggcttctgctctccaccctttagaaccttttccttcggtttgatgctgacaagt

SEQ ID NO: 5718 - DNA, 201 bp, Homo sapiens
gcagaggggatttaaaatggtgcagcaggctgcaggctataggctagaggaattgtattcggacaggggagaagggaaaacagcatcatgctattccgatrcttacgggagtaccaccgtgcttccacccaagacgaaaaggaagacaaaagggagaccgacttcttttggaaggcccagtccaactgtggcctctgcggc

SEQ ID NO: 5719 - DNA, 201 bp, Homo sapiens
aaggcctgtgcacctttcattacagtagctctcatactatatacactgtgcccaggagggaggacagagaagggagaaaaaaaccatctcatataatcacrttgccccaagtcaccatgctgtaataaacaagctgttgggaaggaggaggcagggtggactcgggagagaaaatgaggaggaattccatgctacttctcc

SEQ ID NO: 5720 - DNA, 201 bp, Homo sapiens
ggagggcccccatccttgcagtctatattgacatcatctagtttaaagtgtaatctgtactctacaactcacttactttttgtcaaagttagaattctccragataaaagctggacgcacaaaccagcatggagggcatctttgtctcccccttcagaagtctcccctcctgggaccagggccaccaaggcctgcccagcg

SEQ ID NO: 5721 - DNA, 201 bp, Homo sapiens
aaacaattgtctccacttcaacaggacatggaggtgacagcagaggaacttgagtatgttttaaatgctgtgctgcaaaagagtaagtgccaaccccatcrgggtcctggggcacctatggagggacaagcgaccacactgcctgggtcccctccctgctcctccgagccgcagatctgcttcccagggctgatttgtagg

SEQ ID NO: 5722 - DNA, 201 bp, Homo sapiens
agagtttgagaggctacctgaggtcaggctagtggaaagaaggtctggtgcagacggtgggagaagccgggcagaggaaactcggaaattcacagcaggargctccacaaagaagagcgtccatgtgagtgatccattgccctgcccctcttgaaggagcagccccaacaccagggctgagcctgcccaaggtgatgggtg

SEQ ID NO: 5723 - DNA, 201 bp, Homo sapiens
caaggccattgttgctcttcatcatgacctctgcctgaacaccaattttgtttactcctagttctccggagtggcgttctgttggtccagctgagcagaarcgtctgtgtcacactgctctggatgatggggaattctggtaccgtgcttgttcctgtgttaactgcagatacgagcaagtcccatggccctggggcgtaa

SEQ ID NO: 5724 - DNA, 201 bp, Homo sapiens
atagaataatatatatatataatgcacttcggtgaaacaatatgagagatgtgtgcatatctctctttatatggtatagatacatgaaattttacctaagygcatctctgtaaaaagaaacactgagcagggtggcatgtgtctgtaacctcaataccttgggaatccaaggcgggaggatcacttgaggccaggagtttg

SEQ ID NO: 5725 - DNA, 201 bp, Homo sapiens
atgaataagtgaatgatttaatgaatgagtgaatggatgatgccctcactcttgccctcctgtgcatcgtgtctctccgctttgctgcaggatggcatttmaggacttcaaggcccactttgataaagtggagatctgcaacctcactcccgatgccctggaggaagacgcgatccacaaatgggaggtgacggtccatca

SEQ ID NO: 5726 - DNA, 201 bp, Homo sapiens
atctgtttcttatttaggggagttaggagctttacatcatatcttacagatttctgtaaaatcaggaacaaaagggctgaggatgagcatggagactcttyttgcagcatagagtcgcagggagccggggggtagcgggccatagggaaatcacaagcattgccaggttccctgcagacctctgtggcttgggcatcattt

SEQ ID NO: 5727 - DNA, 201 bp, Homo sapiens
taggaatgggccctggcagagtatcattctccgtgggcagcagcatcccctccaagaaactttctagggccacagctggaagtgacctgagacatagaacrcgaggggaggctggtgtaggaatgaacttggggctcagacaccacccagtgttaagttcccccaaacaaagcttcctgtaaagtcagcgagactctatgg

SEQ ID NO: 5728 - DNA, 201 bp, Homo sapiens
agtggctcacgcctgtaatcccagcactttgggaggttgaggcagttggatcgtgaggtcaggagctcgagaccagctcatagcgaaactttgtctctackaaaaatacaaaaaattagtcaaatgtggtggtatgcacctgtaatcccagctactcgggaggctgaggcaggagaaccccttgaacctgggaggtggagg

SEQ ID NO: 5729 - DNA, 201 bp, Homo sapiens
agggagatttctaaccaccctcccaagtactgccgaaccacttgggtggcagctatgaaatgtctgctcgcccagcccgtgctgacactgatgtatgcagwcttggtcctctggaaagggagttgctggaattcacagagctgatgcatcaggcagccatatgtctgaaacccaagtaagcatgtcctataacagtgccaa

SEQ ID NO: 5730 - DNA, 201 bp, Homo sapiens
atttctaaccaccctcccaagtactgccgaaccacttgggtggcagctatgaaatgtctgctcgcccagcccgtgctgacactgatgtatgcagtcttggwcctctggaaagggagttgctggaattcacagagctgatgcatcaggcagccatatgtctgaaacccaagtaagcatgtcctataacagtgccaagaaggc

SEQ ID NO: 5731 - DNA, 201 bp, Homo sapiens
aagggtctagtatatcaagccaggaagccggctttccctaaggggttactggtagctagtgagaggtgcattctagaaagacccctcctgaaacagaatcygttattagacttacagggtggtcagagctgaccctagaaataatgagatttgctagtttctcttctctccattgctctttccctttctaaaccacccagg

SEQ ID NO: 5732 - DNA, 201 bp, Homo sapiens
tccacgagcgctctgcagacctcccgcctgccgggctgcctgcgcttctcaccaagcacacctcacagataggggcctcctgaaccttttaaagtggttcyctcccagggaaagcaaaatctggaaacatgtccaggctcaggcctgataaaaggatgaagtatacacagccaggaccatctcgggtcctatgtgagggag

SEQ ID NO: 5733 - DNA, 201 bp, Homo sapiens
cagcagggtcctgaaggctggtctgtcactggagccaaatgaagctcagaactgatttaaaacaaaaataaactataaaagaaggtgccaagggctataamaaacaattgtctccacttcaacaggacatggaggtgacagcagaggaacttgagtatgttttaaatgctgtgctgcaaaagagtaagtgccaaccccatc

SEQ ID NO: 5734 - DNA, 201 bp, Homo sapiens
gaagctgggaaaccactgccttgccctgcccagcttttcatgcgctttcctgggttgggatgtctctcaagttaggctctctcctagttgggctggcatgyccctaaaacatgtgacatatgagacacatagctgcagctacacaggagataggtacatctgcccacagcagggtcctgaaggctggtctgtcactggagc

SEQ ID NO: 5735 - DNA, 201 bp, Homo sapiens
tccacctgaccaggagacagaggaggagcagcggtttcgggctctgtttgaacaagtcgctggtgaggtaggacatgccccacttccatctccccaccagsctgagggcctggacctgcttcctagcaaagggttgcagtcgtggggttggtcagcaacgtcatcctgaggcatgatggagcttgttgcaaagtaagacca

SEQ ID NO: 5736 - DNA, 201 bp, Homo sapiens
ccaaagtgctgggattacaggagtgagccaccacgccaggctgcaggacactttcttagcttatctgcaaggcaaggcacatatcccttctagctctgctcctcgctccctcaagcaaaccattgaaaagttgctgttttctactggtcccagagtcatgctcacaagacattcttgggtggagaccttcatttttcagac

SEQ ID NO: 5737 - DNA, 201 bp, Homo sapiens
tgggactcagcattacacggtgcacgtctcagcagcccgtgggaccgtggggctggacggccctcctcctcagcaccaccttcttgtcaaacacagctgtrcttggggagggtgggcagagcacaaagccaaggggacattggagggcagtggacagccaggcttgccctcaagggagcccagggcaaggagtgcactgag

SEQ ID NO: 5738 - DNA, 201 bp, Homo sapiens
gacttcttcagataccacgcttctcgggccagaagcaagacgttcatcaacctgagagaagtctccgaccggttcaagctgccccctggggagtacatcckgattcccagcacttttgagccccaccaggaagctgatttctgtctgagaatcttttcagagaaaaaagccattacccggtgagtcagaggaacagcttcc

SEQ ID NO: 5739 - DNA, 201 bp, Homo sapiens
gggtgcgcctgggggaacacagcctcagccagctcgactggaccgagcagatccggcacagcggcttctctgtgacccatcccggctacctgggagcctcracgagccacgagcacgacctccggctgctgcggctgcgcctgcccgtccgcgtaaccagcagcgttcaacccctgcccctgcccaatgactgtgcaaccg

SEQ ID NO: 5740 - DNA, 201 bp, Homo sapiens; identical to SEQ ID NO: 3441

SEQ ID NO: 5741 - DNA, 201 bp, Homo sapiens
ggtggctgaggagccaggtgcagagtggtagagttggctggcggagtggccagcacatgagaagacaggcaggtaggtggacggagagatagcagcgacgmggacaggccaaacagtgacagccacgtagaggatctggcagacaaagagacaaggtgagaaggaggtaggcgactgccaatgagggagtgacacacaggg

SEQ ID NO: 5742 - DNA, 201 bp, Homo sapiens
gaggaggccccaccaccctccccatctcagctctggcccccagcctggtggtgaggaggagaggggctttctctgtgcctccatttacctgcagctctcakggtactgctcacctcggtctcccctattttttgatccctcttcccttctgtccctctctgaatctctgtctctccatttccctcctatgtgtaagcatct

SEQ ID NO: 5743 - DNA, 201 bp, Homo sapiens
aaggactgggtatgaagtcagggatcagaggtcagaggtcagagtgtgtcagaggtcatcacactggagcaaaaggcatatatatatatatatgtatgtadaggatatgggcattgtgggtcatgggtctggggttagaggtcaccgtagaattaaggtcatgggatccagaggttgtacaatctggtcaaaatctgagga

SEQ ID NO: 5744 - DNA, 201 bp, Homo sapiens
taaccagcagcgttcaacccctgcccctgcccaatgactgtgcaaccgctggcaccgagtgccacgtctcaggctggggcatcaccaaccacccacggagyaaggggcccagggccaggggtcaggggtcaggatgggtacaagtctgggatgcagggcgagaggtcgaatcatgacacctcagaggaaggatgggtaaag

SEQ ID NO: 5745 - DNA, 201 bp, Homo sapiens
gagaggacaagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttggtgagttctcccggagcagggagagggcaggactgcg

SEQ ID NO: 5746 - DNA, 201 bp, Homo sapiens
actctttgtgcaacttcagaatctatgcctggcacctctctgggcctcagtagactgatgttctggaatttttttctttttctttctttttttttttttttggagacagagtcttgctctttctgtcatccaagctggagtgcagtgatgctatcttggctcactacagcctcaaccacctgggctcaagtgatcctcaca

SEQ ID NO: 5747 - DNA, 201 bp, Homo sapiens
ccgccaccatgcccagctaatttttgtattttttgtagagacagggttttgccatgttggccaggctggtctcgaactcctggcctcaaatgacctgcccrtcttggcctcccaaagtgctgggattacaggtgtgagccactgcacccggccaacatgacccaaactctttgtgcaacttcagaatctatgcctggcacc

SEQ ID NO: 5748 - DNA, 201 bp, Homo sapiens
aatggaggagggggaggggcagggagagagagggaggaagggaacagagaaggaaagatggggcaggggttacagagagagacagcaaaacagacggagasgactgggagcccagacagggaaccagctgtttctggggctctaagtctttcccataccatcctccagttggtgctgtcccagactgagagagatttgagg

SEQ ID NO: 5749 - DNA, 201 bp, Homo sapiens
acatatctgagattggaggtcatagcgtttggggtgtggggcccgaagtttggggtcatggaggctggggcccaataaactaggatcaggggacactggcrttggaagcagtgaggtttggaagatgcagagctgaggttggaggttaaggtaaagacagggacatggggtcaggagacagaagatatgagatcaagctgg

SEQ ID NO: 5750 - DNA, 201 bp, Homo sapiens
cttcctctctctgacccatgcccctgtctgtctccagggctcagccaggcagccacaccgaagattttcaatggcactgagtgtgggcgtaactcacagcygtggcaggtggggctgtttgagggcaccagcctgcgctgcgggggtgtccttattgaccacaggtgggtcctcacagcggctcactgcagcggcaggtaa

SEQ ID NO: 5751 - DNA, 201 bp, Homo sapiens
ctgcgtgcctgccacccgctcagccgtcgccaccggcagcaggtactgggtgcgcctgggggaacacagcctcagccagctcgactggaccgagcagatcyggcacagcggcttctctgtgacccatcccggctacctgggagcctcgacgagccacgagcacgacctccggctgctgcggctgcgcctgcccgtccgcgt

SEQ ID NO: 5752 - DNA, 201 bp, Homo sapiens
tgtgtctctccatctctgtatcttttcttcctctctctgacccatgcccctgtctgtctccagggctcagccaggcagccacaccgaagattttcaatggyactgagtgtgggcgtaactcacagccgtggcaggtggggctgtttgagggcaccagcctgcgctgcgggggtgtccttattgaccacaggtgggtcctca

SEQ ID NO: 5753 - DNA, 201 bp, Homo sapiens
tttcccagtccctgtgaagggtttgccttcacatgcctcttccttcccccaggccactgtgggctcgagtaggggatgaccacctgctgcttcttcagggmgagcagctccgccggacgactcgctctgttgtccatcccaagtaccaccagggctcaggccccatcctgccaaggcgaacggatgagcacgatctcatgt

SEQ ID NO: 5754 - DNA, 201 bp, Homo sapiens
gttgtccatcccaagtaccaccagggctcaggccccatcctgccaaggcgaacggatgagcacgatctcatgttgctaaagctggccaggcccgtagtgcyggggccccgcgtccgggccctgcagcttccctaccgctgtgctcagcccggagaccagtgccaggttgctggctggggcaccacggccgcccggagaggc

SEQ ID NO: 5755 - DNA, 201 bp, Homo sapiens
atgagagctccgcacctccacctctccgccgcctctggcgcccgggctctggcgaagctgctgccgctgctgatggcgcaactctggggtaaggtcggggrcagggggcggggagaggcgccggtgggaggcacgggcgggaggagaatgtgttcccgtcaccaagccccgcgcacctctcctcccccgagaccccagcac

SEQ ID NO: 5756 - DNA, 201 bp, Homo sapiens
tggccatgagagctccgcacctccacctctccgccgcctctggcgcccgggctctggcgaagctgctgccgctgctgatggcgcaactctggggtaaggtsgggggcagggggcggggagaggcgccggtgggaggcacgggcgggaggagaatgtgttcccgtcaccaagccccgcgcacctctcctcccccgagacccc

SEQ ID NO: 5757 - DNA, 201 bp, Homo sapiens; identical to SEQ ID NO: 3432

SEQ ID NO: 5758 - DNA, 201 bp, Homo sapiens
cattcccaaacccatccttgaccccaactcttacccagacctaaccccctcctcatccctatcctcaatcccatttccatcctaaccccaccccattcccrtctccaagcccattttcatcccctcaccttccatgaactacaatcccaaccccagtctcactgtgccttcattctcatcccccagcccaacctcccataa

SEQ ID NO: 5759 - DNA, 201 bp, Homo sapiens
ccatgtccactgaggtccccttctcccacaaggccctcttccctcagactcttcctatctccaggccctgcttcactgcccacctgctttcccagtccctrtgaagggtttgccttcacatgcctcttccttcccccaggccactgtgggctcgagtaggggatgaccacctgctgcttcttcagggcgagcagctccgcc

SEQ ID NO: 5760 - DNA, 201 bp, Homo sapiens
agctccgccggacgactcgctctgttgtccatcccaagtaccaccagggctcaggccccatcctgccaaggcgaacggatgagcacgatctcatgttgctraagctggccaggcccgtagtgccggggccccgcgtccgggccctgcagcttccctaccgctgtgctcagcccggagaccagtgccaggttgctggctggg

SEQ ID NO: 5761 - DNA, 201 bp, Homo sapiens
tttacccctgtgtgctctgcccagcatccagctgtctacacccagatctgcaaatacatgtcctggatcaataaagtcatacgctccaactgatccagatrctacgctccagctgatccagatgttatgctcctgctgatccagatgcccagaggctccatcgtccatcctcttcctccccagtcggctgaactctcccct

SEQ ID NO: 5762 - DNA, 201 bp, Homo sapiens
gacccttgccaggtagggtctgaacagggagagtctctgactcctgggagggaggacagggaggttatgggaaaagagcagaccctgtgcccgatccccarctccattcccaaacccatccttgaccccaactcttacccagacctaaccccctcctcatccctatcctcaatcccatttccatcctaaccccaccccatt

SEQ ID NO: 5763 - DNA, 201 bp, Homo sapiens
gcaggtctcgctcttcaacggcctctcgttccactgcgcgggtgtcctggtggaccagagttgggtgctgacggccgcgcactgcggaaacaagtaggagragatccatccccgaggacgccacggggggctgtggaggcggcctccagggaggagcgggcagggcggggtctctcggaactcccacagctggaggtgcgg

SEQ ID NO: 5764 - DNA, 201 bp, Homo sapiens
gggtttgccttcacatgcctcttccttcccccaggccactgtgggctcgagtaggggatgaccacctgctgcttcttcagggcgagcagctccgccggacsactcgctctgttgtccatcccaagtaccaccagggctcaggccccatcctgccaaggcgaacggatgagcacgatctcatgttgctaaagctggccaggc

SEQ ID NO: 5765 - DNA, 201 bp, Homo sapiens
agatgttatgctcctgctgatccagatgcccagaggctccatcgtccatcctcttcctccccagtcggctgaactctccccttgtctgcactgttcaaacmtctgccgccctccacacctctaaacatctcccctctcacctcattcccccacctatccccattctctgcctgtactgaagctgaaatgcaggaagtggtg

SEQ ID NO: 5766 - DNA, 201 bp, Homo sapiens
ccctctcacctcattcccccacctatccccattctctgcctgtactgaagctgaaatgcaggaagtggtggcaaaggtttattccagagaagccaggaagycggtcatcacccagcctctgagagcagttactggggtcacccaacctgacttcctctgccactccccgctgtgtgactttgggcaagccaagtgccctct

SEQ ID NO: 5767 - DNA, 201 bp, Homo sapiens
ctaggccttcctccttcctcttccacagtctggcttctcacattgtcactctaggtatgcacttcccattgatttcctcttgctcagtggcctctcatccygccacccctagccttgctggggacgtgaaccctctccccgcgcctgggaagccttcttggcaccgggacccggagaatccccacggaagccagttccaaa

SEQ ID NO: 5768 - DNA, 201 bp, Homo sapiens
cagcccaacctcccataacctgaagtccacctccattcctaccttccagctcatacctaattccaaccccatcccatcctcgtctttatcccaacccaacyccttccttccccaccactgccccagatcccaaagtgacagctctcacgttggcacatttatttgatctctcctttctgccacccccagagtgactctgga

SEQ ID NO: 5769 - DNA, 201 bp, Homo sapiens
ttcacgcgcttcttctcctcccattcccttcggtgcacgcgaaacccccaatatttccctaccaccctcgcgttctggctgcgtcccccgtccccgaacgyagtccagtgccacagcccagctccaaccccaaacccagaccctgccctccgtgctttgattccgtcccctttctttctccagccgcagaggcggcgctgc

SEQ ID NO: 5770 - DNA, 201 bp, Homo sapiens
atcctcgtctttatcccaacccaaccccttccttccccaccactgccccagatcccaaagtgacagctctcacgttggcacatttatttgatctctccttyctgccacccccagagtgactctggaggccccctggtctgtgacgagaccctccaaggcatcctctcgtggggtgtttacccctgtgtgctctgcccagca

SEQ ID NO: 5771 - DNA, 201 bp, Homo sapiens
acgactcgctctgttgtccatcccaagtaccaccagggctcaggccccatcctgccaaggcgaacggatgagcacgatctcatgttgctaaagctggccakgcccgtagtgccggggccccgcgtccgggccctgcagcttccctaccgctgtgctcagcccggagaccagtgccaggttgctggctggggcaccacggcc

SEQ ID NO: 5772 - DNA, 201 bp, Homo sapiens
tctttcttgttttactttctctcttattttttcttctttctttcttgtttttttctttctctctctttttctttccttcttttttttttttttttttttttgagacagggcagtgctctgtctccgtggctggagtacagtggcccaatcagagctcactgcagcctcgacctcctgggctcaagcgatactcagcctcca

SEQ ID NO: 5773 - DNA, 201 bp, Homo sapiens
tttcaccgtggtctcgatctcctggcctcgtgatccgcctgcctcggcctcccaaagtgctgggattacaagcgtgagccaccgctcccggccacaccacmgtgttttatcctgagtcttgccttaccgctttttgccctctcccctcactttttttcttcctctttccctttctctctcttttttctttttctttctttc

SEQ ID NO: 5774 - DNA, 201 bp, Homo sapiens
gtggcaaaggtttattccagagaagccaggaagccggtcatcacccagcctctgagagcagttactggggtcacccaacctgacttcctctgccactcccygctgtgtgactttgggcaagccaagtgccctctctgaacctcagtttcctcatctgcaaaatgggaacaatgacgtgcctacctcttagacatgttgtga

SEQ ID NO: 5775 - DNA, 201 bp, Homo sapiens; identical to SEQ ID NO: 3444

SEQ ID NO: 5776 - DNA, 201 bp, Homo sapiens
aacctcagtttcctcatctgcaaaatgggaacaatgacgtgcctacctcttagacatgttgtgaggagactatgatataacatgtgtatgtaaatcttcakgtgattgtcatgtaaggcttaacacagtgggtggtgagttctgactaaaggttacctgttgtcgtgatctgaccacgtcccggtgaaagcgtgtgtccag

SEQ ID NO: 5777 - DNA, 201 bp, Homo sapiens
gtgcccgatccccaactccattcccaaacccatccttgaccccaactcttacccagacctaaccccctcctcatccctatcctcaatcccatttccatccyaaccccaccccattcccatctccaagcccattttcatcccctcaccttccatgaactacaatcccaaccccagtctcactgtgccttcattctcatcccc

SEQ ID NO: 5778 - DNA, 201 bp, Homo sapiens; identical to SEQ ID NO: 3446

SEQ ID NO: 5779 - DNA, 201 bp, Homo sapiens
ccatcccggccccgctccattttacactaccgtgttttgttttgtttgtttgtttgtttgagacggagtctcgctctgtcgcccaggctggagtgcagtgrcgcgatctcggctcactgcaagctccgcctcccgggttcacaccattctcctgcctcagcctcccgagtagctgggactacaggcgcccgccaccaagcc

SEQ ID NO: 5780 - DNA, 201 bp, Homo sapiens
gcagcttccctaccgctgtgctcagcccggagaccagtgccaggttgctggctggggcaccacggccgcccggagaggcaagagctggggctctgaggccrgaacctcaggaggagggggctgagggcctgaacccctgggtctgaggaaggatgggctggggactggattcctggatctgagggaggacgggctggggtc

SEQ ID NO: 5781 - DNA, 201 bp, Homo sapiens
gaggcggcctccagggaggagcgggcagggcggggtctctcggaactcccacagctggaggtgcggtccccggtgtccttccagcaggaggagagaccggscttgcgctgtggccgccagggggcggtgtggtccttttccgcatttctgggcccgtcactcctctcccgctgattctccttgagctctaggaggaggtgg

SEQ ID NO: 5782 - DNA, 201 bp, Homo sapiens
aggcggcctccagggaggagcgggcagggcggggtctctcggaactcccacagctggaggtgcggtccccggtgtccttccagcaggaggagagaccgggsttgcgctgtggccgccagggggcggtgtggtccttttccgcatttctgggcccgtcactcctctcccgctgattctccttgagctctaggaggaggtggt

SEQ ID NO: 5783 - DNA, 201 bp, Homo sapiens
ttccttctcatctcccactgtttcccacttctggttccacccaacaccagttcctcctgccttggcacgagctaggctggccctgagtcattagcaccttytctgccttcatgaggccactgaactcaagggacctcaccttgcttccatcccagcctctaagaccagagggccgagggggtagtgaagattgggaaaccc

SEQ ID NO: 5784 - DNA, 201 bp, Homo sapiens; identical to SEQ ID NO: 4893

SEQ ID NO: 5785 - DNA, 201 bp, Homo sapiens; identical to SEQ ID NO: 4879

SEQ ID NO: 5786 - DNA, 201 bp, Homo sapiens
agcacctggcctgggtcacttgccttcctgaggccaaggtacaggtgagctgtgaccccttctcacacagccaacatctaggcttggcccacagccccttsgctgggtagcctgccttcaggttgtttcccctgtccctgggtggaggggatgctggggccagaacagaccccttcttctttcctagcaggtgtggttcca

SEQ ID NO: 5787 - DNA, 201 bp, Homo sapiens
ctagaggggccatcaggcggaagaagagggatggggacaggtgtgggagtccggatggggttggattttctttgctttgggccagagaagatgctagggtkaggcttggagatggagtaggaagagaagttagaataggggtgaggttggagttggggttataggtggggattgcgttgtttgaggtggataatgtgatag

SEQ ID NO: 5788 - DNA, 201 bp, Homo sapiens
actgccaaagccggtatgaaggcaggggctcagggtcctgagggagcctggttcggggggaagagctcctagatttgggggaagacggaggcagacgccasaactcctgggttctgaaagacgaggaggccggatgtcaagcccctgggttaggaaggagtgtgtgtttcaaagccttcgatctctgaaggaggaaggaga

SEQ ID NO: 5789 - DNA, 201 bp, Homo sapiens
ctccccacactgggtgctgtctgcggcccactgccaaagccggtatgaaggcaggggctcagggtcctgagggagcctggttcggggggaagagctcctakatttgggggaagacggaggcagacgccagaactcctgggttctgaaagacgaggaggccggatgtcaagcccctgggttaggaaggagtgtgtgtttcaa

SEQ ID NO: 5790 - DNA, 201 bp, Homo sapiens
gattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattga

SEQ ID NO: 5791 - DNA, 201 bp, Homo sapiens
ctacgagcgtggacgctttaactgtggcgcttccctcatctccccacactgggtgctgtctgcggcccactgccaaagccggtatgaaggcaggggctcarggtcctgagggagcctggttcggggggaagagctcctagatttgggggaagacggaggcagacgccagaactcctgggttctgaaagacgaggaggccgg

SEQ ID NO: 5792 - DNA, 201 bp, Homo sapiens
tgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactaga

SEQ ID NO: 5793 - DNA, 201 bp, Homo sapiens
agggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgct

SEQ ID NO: 5794 - DNA, 201 bp, Homo sapiens
ttgcccagtggagaggggtcctggtcctgtgaccttgaatgtctctaatcatgtccttaagcataatgccattctgtgtgtgtgtgtgtgtgtgtgtgtgkacatgcacgtgtgcagtgggtatacaaggccctgtatgttcacatcctctccacatgcatgagccagatccccatatgtgaaacccaatcagtgactcca

SEQ ID NO: 5795 - DNA, 201 bp, Homo sapiens; identical to SEQ ID NO: 3413

SEQ ID NO: 5796 - DNA, 201 bp, Homo sapiens
taacgttctgccacaaatgaccctcactcctgggggcccctgagacccccacgcctccagcctcccctccggctctctctgtgcactcacctacctgcctygcgcctgcctgctgcgcccagctggggcctccaccttcctctggcttggactggccaggtgcagcctcggtgcccagctgttcagcccgtaccctccgcc

SEQ ID NO: 5797 - DNA, 201 bp, Homo sapiens
aagaaattaattgtaacctgatgcctctcttctggagaaattggggggtggactttcattaacgttctgccacaaatgaccctcactcctgggggcccctsagacccccacgcctccagcctcccctccggctctctctgtgcactcacctacctgcctcgcgcctgcctgctgcgcccagctggggcctccaccttcctc

SEQ ID NO: 5798 - DNA, 201 bp, Homo sapiens
tgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactc

SEQ ID NO: 5799 - DNA, 201 bp, Homo sapiens
ccaagaaattaattgtaacctgatgcctctcttctggagaaattggggggtggactttcattaacgttctgccacaaatgaccctcactcctgggggcccytgagacccccacgcctccagcctcccctccggctctctctgtgcactcacctacctgcctcgcgcctgcctgctgcgcccagctggggcctccaccttcc

SEQ ID NO: 5800 - DNA, 201 bp, Homo sapiens
aggcagaagcataagcctggcccaggtagtgccccttcaggtgtgcaagccaggcacggtgcttagagcttacatacaacgtctatgtgtggtgggcaccmccgacctcatttgacaagggaaggggctgtggctcagagggacggccacaacatcaaggtcaccttgggtgtcaggcaaactccagattgaactcagctg

SEQ ID NO: 5801 - DNA, 201 bp, Homo sapiens
agtcccacacctgccactccctgtctcttacagggtctttgaggggattaaatgtggttgtgtgtgaggcagaagcataagcctggcccaggtagtgcccyttcaggtgtgcaagccaggcacggtgcttagagcttacatacaacgtctatgtgtggtgggcaccaccgacctcatttgacaagggaaggggctgtggct

SEQ ID NO: 5802 - DNA, 201 bp, Homo sapiens
atgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggt

SEQ ID NO: 5803 - DNA, 201 bp, Homo sapiens
ctgagctgagtcctggggcaaccgcttccttgctgtgtgtccttgagggaactgcttcacctctctgggcttcgaatgccttctctataagacagcacccrcttgagacaataacagtgaggtctcaatagcataacagaggtaatatacatagcaagcattagacaagtgctgagaggccaacagcacagacagactcca

SEQ ID NO: 5804 - DNA, 201 bp, Homo sapiens
ctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacaca

SEQ ID NO: 5805 - DNA, 201 bp, Homo sapiens
cagtgaggtctcaatagcataacagaggtaatatacatagcaagcattagacaagtgctgagaggccaacagcacagacagactccagcttgagtcccacrcctgccactccctgtctcttacagggtctttgaggggattaaatgtggttgtgtgtgaggcagaagcataagcctggcccaggtagtgccccttcaggtg

SEQ ID NO: 5806 - DNA, 201 bp, Homo sapiens
agactccagcttgagtcccacacctgccactccctgtctcttacagggtctttgaggggattaaatgtggttgtgtgtgaggcagaagcataagcctggcycaggtagtgccccttcaggtgtgcaagccaggcacggtgcttagagcttacatacaacgtctatgtgtggtgggcaccaccgacctcatttgacaaggga

SEQ ID NO: 5807 - DNA, 201 bp, Homo sapiens; identical to SEQ ID NO: 3402

SEQ ID NO: 5808 - DNA, 201 bp, Homo sapiens
ggggattaaatgtggttgtgtgtgaggcagaagcataagcctggcccaggtagtgccccttcaggtgtgcaagccaggcacggtgcttagagcttacatacaacgtctatgtgtggtgggcaccaccgacctcatttgacaagggaaggggctgtggctcagagggacggccacaacatcaaggtcaccttgggtgtcagg

SEQ ID NO: 5809 - DNA, 201 bp, Homo sapiens
tctggcttggactggccaggtgcagcctcggtgcccagctgttcagcccgtaccctccgcccttcggaggacgacctcacccttcctttgttaagcccctygtccaccacatccgcattcccctggtctcacgggggcctttggcccagttcctgactgtgatggggagagtgtgggcatttggtctggctgtgcaaatcc

SEQ ID NO: 5810 - DNA, 201 bp, Homo sapiens
tgaaacccaatcagtgactccacagatctggcttgggggctgatctagagatggataaatatgtcctgccctggctgcctctggcttcagctgcatgtctytgaccttgaatgcccagccccgtgtctgggtgctgccccagacagcaagtccacatctgagtgttggccttctgggttggtgtctgcagctctaactcta

SEQ ID NO: 5811 - DNA, 201 bp, Homo sapiens
tacacaaacaagcaaaaggggaggatgagagtggtcattcgggtttgctttggaggtccagagaaaatgcaagtccaacttccaggcacagaccagttgcycgcagcaggcttcctcccattggtctcagaccaaggtgagccactcccccgggcgggacagagaaagctcctctggaagccagacaagctcggccacctc

SEQ ID NO: 5812 - DNA, 201 bp, Homo sapiens
cctgttgctaagcttcaattatcagtttgttgtattgctgcaactcacggatctgaaaaactcataaatgaaaagagagagagacatcagcctgtcaaatrtatgtaataattttaacgtaatttaaggtagcataacaagttattttcaacctgatcacatttctttaaaaaaaaaaaaaaagggtttattgagatataa

SEQ ID NO: 5813 - DNA, 201 bp, Homo sapiens
atgaggaaaggagagcagagagggtcaataacgtgccccggtacaatgcatcagtagacttctaattctccaaccctcatctcagaggggaatggtgtcakgaaacaagactggggggaaaagggagaaggcctgctttctagtcgagaaaagcggagaccgtctgaaactctacttgctccaacaggtgaacgtgattga

SEQ ID NO: 5814 - DNA, 201 bp, Homo sapiens
ataatccaatggttttaagtatatttagagctatgcagccatcgccacaaactaattttagaacaattttcatcaccccaaaaagaaaccctgtgcccacyagcagtcactccccattccatccgcccccagcccctggcaaccactcatctaccttctgcctctatggatttgtttattctagacatttcacataaaccg

SEQ ID NO: 5815 - DNA, 201 bp, Homo sapiens
tcagccccagcagcggagacgcggtgcggcccagggtgctgtcgctgctgcctgcgcgccgcagggggatcagcgctgtgtgcggagaggctcgtgcgcayggaaggggcgaggtgcgggtcgcggggcccgggaaccgcggagcccgccccggcaccaacttccctaccgagtcctcgcgcctagccgggaaacacggct

SEQ ID NO: 5816 - DNA, 201 bp, Homo sapiens
ctgtctttatttctccaccagacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcaggtactgagtcagtcaagacttcagcaaa

SEQ ID NO: 5817 - DNA, 201 bp, Homo sapiens
gggatcctggggggaagctttggtatcatggagtaaaaacatacattaaaacaccccctccctcctgcctgtgttctcaaaaatcgccgtcttgcacaaasaatatccttcaagaagaacgctccaaaagaaaaacagcctattttaaaatgcccgactcctgcgtcggcgaaggccatccctgctgttttgaatttcaga

SEQ ID NO: 5818 - DNA, 201 bp, Homo sapiens
tgcccggtcagccccagcagcggagacgcggtgcggcccagggtgctgtcgctgctgcctgcgcgccgcagggggatcagcgctgtgtgcggagaggctcktgcgcacggaaggggcgaggtgcgggtcgcggggcccgggaaccgcggagcccgccccggcaccaacttccctaccgagtcctcgcgcctagccgggaaa

SEQ ID NO: 5819 - DNA, 201 bp, Homo sapiens
cagaaccagcctcgggcccagccggcccaactcagaaaaaggcaggggtcagtctccagcctggactcctctaaaaatcagaaagcagtgccccagcaaaygaacaacaacagcgctcacctgaaacagtttcaccttcatttttagaggagaggaacacaataggagggcgtattactccacgggttttaaccctagccc

SEQ ID NO: 5820 - DNA, 201 bp, Homo sapiens
taacaagttattttcaacctgatcacatttctttaaaaaaaaaaaaaaagggtttattgagatataattcacataccattaaagtccccgatttaaagtayataatccaatggttttaagtatatttagagctatgcagccatcgccacaaactaattttagaacaattttcatcaccccaaaaagaaaccctgtgcccac

SEQ ID NO: 5821 - DNA, 201 bp, Homo sapiens
agtaaggcagaggttgcagtgagcggagattgcaccactgcactccagcctgggcaacagagcaagactgtctcaaaaaaaaaaaaaaaaaaaaagggccytattcaactggcagcaattccccagtgttgtggggaaggaggactggaggccccagagagagcccaccagggccacccaccatgaggaggagaaaaaaag

SEQ ID NO: 5822 - DNA, 201 bp, Homo sapiens
atcaaacatctaaacaaatctctcttctggaaaaataagaaaatgaaaaagcaattacacgtcacatggctgattagcaataaatttcatttgtgactacrgtggcatgagagtttgactcctgacttgctttccttgaaagaaaaaaattatctgcaatactgtctcttgatatagaaaacagacccattccatctgact

SEQ ID NO: 5823 - DNA, 201 bp, Homo sapiens
gaatggtgtcatgaaacaagactggggggaaaagggagaaggcctgctttctagtcgagaaaagcggagaccgtctgaaactctacttgctccaacaggtsaacgtgattgaaaattcagaattcactctcctaatagcaggaaagtgttacaaaagcccacaggccaaatgataccaccctcccaggaagtctcttgcag

SEQ ID NO: 5824 - DNA, 201 bp, Homo sapiens
tttctagtcgagaaaagcggagaccgtctgaaactctacttgctccaacaggtgaacgtgattgaaaattcagaattcactctcctaatagcaggaaagtrttacaaaagcccacaggccaaatgataccaccctcccaggaagtctcttgcagaactgtgttttttaatgttatttgtcaagtgaaaacagttacagtgg

SEQ ID NO: 5825 - DNA, 201 bp, Homo sapiens
ttctatgaatgtttaaagtagattctattaaaattataatttcacagatgaggaaactgaggcacaagaagattaaattatttgcctgagagcttagctastgaagagctgagattcaaaccagccactttggctccatggtcctaataaaattacaagcaaggaacaagacaaatcactgtcaaccagcaaaaccgtggg

SEQ ID NO: 5826 - DNA, 201 bp, Homo sapiens
caaataattccaaagccagtttgagaaagctagtgccatgttaaaaagaaaatggttgaacaaaagtatacaaaacagcaacaacaatgtatttcaaactygcagaatttggacgatggacggatggatggagatacacaattctgaacaaacggcattcgtattatgtaactcttactgaagtagagacctatggtatta

SEQ ID NO: 5827 - DNA, 201 bp, Homo sapiens
gatcatgggctcctacctggaatttctctccatgcttcctactttttccaggaagttatcaaaggtcactaagacgctttgaatttggggaaaactcctayaaataaattcatctctccctaattaccattagacttctgttctttaaagttctattgactaaactttggctgacttaaattggtgatgtctcatttacgt

SEQ ID NO: 5828 - DNA, 201 bp, Homo sapiens
ttaatactttgagtcaaataaaaccaaagcaatttaacaaaagaaaacatcatgccgaggaagtatgcttctcttgagataacaatctaacttgttttaaagatcctttgtttactaaccattttatattccaaatatatgttccttcctcagaacaaatcaattcttttccagaccctcggggatgggggtgcaggcatg

SEQ ID NO: 5829 - DNA, 201 bp, Homo sapiens
agaggaacacaataggagggcgtattactccacgggttttaaccctagcccttgatgctaccaggtatccatgatgcccctaataaaggtgacagttcctycacttttctaacatccagctattctttaaaaaagttgaacactgcagtttccggagaactttgctatgtgaattgcctcactgcaggtgtgctctcccct

SEQ ID NO: 5830 - DNA, 201 bp, Homo sapiens
gggtgaaattacagctaactcttaaaggagcttgccagagggcaagctggtagtattgtttgctattccaagcagaggggcttccacctgccaagacaaaragacacgaatgagtacagcctgaactgttcaaaatgtctgggaggaagggaggctgaagttctctctcagacagccaaacaaagatttccgaattaaaaa

SEQ ID NO: 5831 - DNA, 201 bp, Homo sapiens
ttgttaatactttgagtcaaataaaaccaaagcaatttaacaaaagaaaacatcatgccgaggaagtatgcttctcttgagataacaatctaacttgtttwaaagatcctttgtttactaaccattttatattccaaatatatgttccttcctcagaacaaatcaattcttttccagaccctcggggatgggggtgcaggc

SEQ ID NO: 5832 - DNA, 201 bp, Homo sapiens
ggagctcaagtcagtgcaatcattctgcatgcagaatcaaggccagagagagggtgaaattacagctaactcttaaaggagcttgccagagggcaagctgrtagtattgtttgctattccaagcagaggggcttccacctgccaagacaaagagacacgaatgagtacagcctgaactgttcaaaatgtctgggaggaagg

SEQ ID NO: 5833 - DNA, 201 bp, Homo sapiens
accacccatcaggtttccaggaactaaccactgtaaagggatcctggggggaagctttggtatcatggagtaaaaacatacattaaaacaccccctccctyctgcctgtgttctcaaaaatcgccgtcttgcacaaagaatatccttcaagaagaacgctccaaaagaaaaacagcctattttaaaatgcccgactcctgc

SEQ ID NO: 5834 - DNA, 201 bp, Homo sapiens
gagaaagctcctctggaagccagacaagctcggccacctcgaagtcttctttggaatccagcaggtccaggcctgagccctggcgcctggttaaaccaaargatgacaaccaagcagaaaaaaatagccccagagagtatctgctggagaggcagacaggcggacctggccttcgacacacagcatgcgtgccatggtctc

SEQ ID NO: 5835 - DNA, 201 bp, Homo sapiens
ttttggagctttaaatttattaaagtcctgtaaaattatcttaaaactctaactgtaaaagacacactaggtgttaacagctctgccatggagttgcagtrcgcctgtctgcatcacttaggaagaccctaattctctcaggacagctcgcactgacacagtagagtaaccttaatccaaaactgtagcccagtgatttct

SEQ ID NO: 5836 - DNA, 201 bp, Homo sapiens
tctgagatgccaccctggccctctgcaccaggccactccggagaccaccaggcagccgagtccagcctgcagatgcttcctcctcaggaacccagctccargagggtttaaaagcacactacagacataaatcggtgccaatgaattattcattacatcttatctatagggaacttatggaacaaagtctccatccacagg

SEQ ID NO: 5837 - DNA, 201 bp, Homo sapiens
aaactagagaagctatacagttcaactgcataacataacaaaatggattatttctcccgtgtcttctaaaccgtacttatcttttaaagataaaaaccctyctttgtccccccagccaccacctaaacgacttagtaaagggagccggaaggctttcgcccaatcgagtccgctgaaagtttagaaaacaaagagcaggag

SEQ ID NO: 5838 - DNA, 201 bp, Homo sapiens
gtaagctttcttctgtccagaggtcgggagctggcctcaccgtcgccctaccaggacactgtcaaaggccttcaccagcaaccaaaaccggcagggttggrgagggtgcttcaatgatagagagacctgtaagaccttgctactgtccctcccaggagtgaggcaaaagcttactggcctcaccaagaaaacaatgcaaaa

SEQ ID NO: 5839 - DNA, 201 bp, Homo sapiens
tggcacccctctttaaacaaactgttcctcttcacttgcatggtaaggactggaaagagccctgccgcgttggccagctcttcagggtagcgggggccacygccctctcccagcctcgggaagcccaaggccactgcatcagcctggcccagcccagaaccagcctcgggcccagccggcccaactcagaaaaaggcaggg

SEQ ID NO: 5840 - DNA, 201 bp, Homo sapiens
gcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtattttttttttta

SEQ ID NO: 5841 - DNA, 201 bp, Homo sapiens
ggcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtattttttttttt

SEQ ID NO: 5842 - DNA, 201 bp, Homo sapiens
caactgggactgctctctcgacaaaccaccccagcccacagctcctctggcaacccagcccctcacaccgaggacccatctcaccagtcacctccctcagstgggccaacctgtccagtccattcctgcttcctggtctcaggtctagagacaagacttccctccctgagcctgtcctcactgcctccctcatctatacca

SEQ ID NO: 5843 - DNA, 201 bp, Homo sapiens
aatcactcaggtctgcactaggaagcgagttatgatgatgcccctaatctatatgaacccaaataaagccaaaacacacacaccttttaaggataaaactrtattccattaaaattagccccgcatttgtcaatatctaacagcattggactgaccctcaggccagaggctgtagctcttggaagatcctagccaggaggt

SEQ ID NO: 5844 - DNA, 201 bp, Homo sapiens
ttgtttcttggtcacagttgatccctcaactcaagcatctcaccctcaaaatgtttgtttgggacccaagaggcaaaccttgagatgggttatttctttcrccttggattggctcatctgctgggagtggagccaagctgacatttcctttcctttttgtctgcctatcactacgtagaggcagcacataagagagggaaa

SEQ ID NO: 5845 - DNA, 201 bp, Homo sapiens
ctattcagttcacttcatctcggaaatacctgacccctgccttggatccagcggccctcctgagagctgaggaaggaggaaatcctatgtgtctgctcccrgagctgccacaacccatcttcccacaactcggaacttggaaaaaggaacccaggacacgactttgcttttcttttggacctagttggtgattatactctg

SEQ ID NO: 5846 - DNA, 201 bp, Homo sapiens
tggtttttacttgatttgctgatgttttattttttagaaaattgcagatgtgatttttaggcagctgattggaatgttctggttgctctgaataggactarctactttgttttttactgaaggacaaatattattcctacacacataaaaaacctcaaagaatgagtaatgatactgtttaaatctgcccttataactcca

SEQ ID NO: 5847 - DNA, 201 bp, Homo sapiens
acaacatccatcatatatctacaaaattgggatttttttatcgtaaaatttcatctaaaacaaaaaattcacatctgttcttggtatccattaggtgtagyggacacctctagatattcttgatgccagcatcctgtagacccgccatctcctttcccaggccatggggtgtttctgttttctattagacactgtctctta

SEQ ID NO: 5848 - DNA, 201 bp, Homo sapiens
ttgcctgattatgaagtaataaatattcaccataaatattttgaaaaatataaaactgtctataaaagaaatttgaaatgattgctaatctcaaaatataaagatacctgtcagtactttggcattttatcctccttgtggctgaggtcacatatcttgagactgaagcacaaaatttctataccatacagtttatagttt

SEQ ID NO: 5849 - DNA, 201 bp, Homo sapiens
ctctttcaggttctgccctgatgtttcctggaataatgctgaggactgcctttcgggtagccgccctattcagttcacttcatctcggaaatacctgaccyctgccttggatccagcggccctcctgagagctgaggaaggaggaaatcctatgtgtctgctcccggagctgccacaacccatcttcccacaactcggaac

SEQ ID NO: 5850 - DNA, 201 bp, Homo sapiens
ccctaactttcagctgtgtacttcttttcctctttcaggttctgccctgatgtttcctggaataatgctgaggactgcctttcgggtagccgccctattcmgttcacttcatctcggaaatacctgacccctgccttggatccagcggccctcctgagagctgaggaaggaggaaatcctatgtgtctgctcccggagctg

SEQ ID NO: 5851 - DNA, 201 bp, Homo sapiens
tgcctgattatgaagtaataaatattcaccataaatattttgaaaaatataaaactgtctataaaagaaatttgaaatgattgctaatctcaaaatataaagatacctgtcagtactttggcattttatcctccttgtggctgaggtcacatatcttgagactgaagcacaaaatttctataccatacagtttatagttta

SEQ ID NO: 5852 - DNA, 201 bp, Homo sapiens
gtttttcttctttcagggttgctttctctatggatcaaggtaagaaggaagaaaagctaggtctcctatctatctcacacagcagattttaaaatattttwaaaatattttaaatactttcaattttttaatattttaaaaacttttaaaactaactactgtatcgtgtacctatgaaatttcgttttcagtgcaattcaa

SEQ ID NO: 5853 - DNA, 201 bp, Homo sapiens
cctcctctgtgtctgtgagtggctggctccttctcaaccttcattcaggtctccgctcaaacaccaccctcaccaccatgcccacctgccagctactatcmcacagaccttcattttcttcatgaggtgattctgaagagaaaataagcttgggagctatcaccctaacttacttattccctcagtgatggaatttggggg

SEQ ID NO: 5854 - DNA, 201 bp, Homo sapiens
gccagactgtccaagctgaaaacgtaaacaaaagctccttgcaggaagcaacagggtgcaaacttgccacctggggggcctctctgccaccccttggccarccctctcctccagcatctggccccaccccggccctgcccgcctggcatgtaaagcaccccctcctctccaagcatccgttcctcagccgctgtgttcctg

SEQ ID NO: 5855 - DNA, 201 bp, Homo sapiens
taagcttccaacacagcaggttcagagaggttaggaaaaataagcaagggaaagaaacaagtactgatctaacaatgacggaagctgactccatgccttaktggatgcttgcggaggatggcactatcttggctgggctgactgtattagcaatgcatgtatctaaatcagctctaaaacccatagagagactggcacttt

SEQ ID NO: 5856 - DNA, 201 bp, Homo sapiens
tctggttggtcttgactcacaacccattcctcattctggcctctccatcctcacaggacccccagccaggggaaacttcccagcttccagcgggaagtgcygcttccccaaattgggcagcacctggggatgcctctagatgcataatcacctcagaggtcctgagccagagtccagagattctttctgagattctggcaa

SEQ ID NO: 5857 - DNA, 201 bp, Homo sapiens
gggtatagaaagatgttcaggacttagaatataccttttctcatggttctcttatcccaacgtataaattgtgacaatttgtttaaaagattgaactaaaytatgatattctctttgtcttccaaatttatttagacttggtatcctgttctttctctggaatttcctttgcttttctttttgtcagtaagctaaattact

SEQ ID NO: 5858 - DNA, 201 bp, Homo sapiens
gctggggctggatgacagagcctcagcagtgacagggaagcctgcttacttccctcatgctcagagtgccttttggccacgggcttatttcagctgtcttktgttccatttctgaggctctaaagggatgctctgggaactgggatctaggaataaatcaagatgagtggggcaaggttaataccctgattagatcagcct

SEQ ID NO: 5859 - DNA, 201 bp, Homo sapiens
gagagtggtgctccatgttccaaggaagaaaagcaacccacagctcctcctgcccgtgcagcagatgaccagaaagacgagaaagggaaacaaactcccaytcatggtgaggctgcttgtttctcaaacacacttttccaatgcctccacaagttgtttgtttctgtattttgaaagcactcaacatgcagagtatttgct

SEQ ID NO: 5860 - DNA, 201 bp, Homo sapiens
agaggcctaaaaagccaggtggacagagaccacatgtgaccccaaacagaaacaggctgctggaaactaactctctctctctctagctgatacttattcarcacttactgtatgtcaggtactattctaaaaactttacgtatagtaactcagttttcacacagatgcaattattttccatactttagagatgagaacatt

SEQ ID NO: 5861 - DNA, 201 bp, Homo sapiens
tgcagcagatgaccagaaagacgagaaagggaaacaaactcccattcatggtgaggctgcttgtttctcaaacacacttttccaatgcctccacaagttgyttgtttctgtattttgaaagcactcaacatgcagagtatttgctaaccacaggcagagtacccagtcaggatgtaccaactcaaactcctccctggggca

SEQ ID NO: 5862 - DNA, 201 bp, Homo sapiens
aatgctggggtggccatggaagaattctgcccaacagaggatgatgttccttaagcttccaacacagcaggttcagagaggttaggaaaaataagcaaggsaaagaaacaagtactgatctaacaatgacggaagctgactccatgccttagtggatgcttgcggaggatggcactatcttggctgggctgactgtattag

SEQ ID NO: 5863 - DNA, 201 bp, Homo sapiens
ttacatcagggaagtttctagtcaaaatgttattcctgtctacagggaaaaacaaaagcaaaacacaaaagaacactgcttctaatggcatcatagcaagsagtttatctagaaagatgatgccagcagtcacctcttttccaggaagacagaaacaaaaaccgttctcctcgagaggccaacagtgtagaagcccctttt

SEQ ID NO: 5864 - DNA, 201 bp, Homo sapiens
acacatttatttaaaaatatcccaacaaagtgttgcaaaatttcccttgattgcaatgattctttaagctgttaacattaatcttgggtggatgcaggagytgtccactggctttccaaaaggcatccaatgcctttaaggcagcataagagaaacactgcccctctcgatgaactgggtccctgagtctggcagtactgc

SEQ ID NO: 5865 - DNA, 201 bp, Homo sapiens
tacctggctccaaagccttttcctttccagatggtacactgcccacatctcttagtttatcggcacagggtcaagaaggtggtgagggtatggactgacayggcatctacggagctttccatacttataccaagacgcccccctgtaaagagtggactgtccggtagccgggcaaggtggctcataccttaatcccagcac

SEQ ID NO: 5866 - DNA, 201 bp, Homo sapiens
gcagcttcttctctagcaactgttaatttaatagactactacttatggtgaaacaaaaaacaatcccactctgaagaaagcactgaagacctataaccagyggtgaatttcttccgtattgctcagtggaaacaaaagaaagctcaaatgggtgagtttttcttctttcagggttgctttctctatggatcaaggtaagaa

SEQ ID NO: 5867 - DNA, 201 bp, Homo sapiens
gcctttagaaggacacaatgggatgggggggaatcaaagggtgatagtcttaacaataaatagaggttgagatcctaatcaagaatcaaagcaatacattytgagttggcattcacaaatgagtaagtcaaatggtgtggggcataatgctggggtggccatggaagaattctgcccaacagaggatgatgttccttaagc

SEQ ID NO: 5868 - DNA, 201 bp, Homo sapiens
gaaggatcacttgaggtcaggagttcgagaccagcctagccaacatggtaaaaccctgtctttactaaaaatgcaaataatagccaggcatggtggtacgygcctgaaatcccagctacttgggaaactgagggatgagaatcacttgaacccaggaggtagaggttgcagtgagccgagatcatgctactgcactctgac

SEQ ID NO: 5869 - DNA, 201 bp, Homo sapiens
gagaccacatgtgaccccaaacagaaacaggctgctggaaactaactctctctctctctagctgatacttattcagcacttactgtatgtcaggtactatyctaaaaactttacgtatagtaactcagttttcacacagatgcaattattttccatactttagagatgagaacattgaggcatagagaggttaagtaattt

SEQ ID NO: 5870 - DNA, 201 bp, Homo sapiens
caaagactcaaggaccatttgaacaaagacatccacatctataccacagatgacttggcatctatggaggagtggaggtgagcaccactctaccatgtagrggaagcagccactgtggaggctgggcttgtggagattccttctggatgccctcagatctgtcattaatggggacaaagcagaatcaagggactgctctat

SEQ ID NO: 5871 - DNA, 201 bp, Homo sapiens
ttggcatttagaagcttcattcaacttttggccttttcaaggctaaatgaatcttagggaagaaataaaaagttcccattgattcacttaaaaaaagattkcttgcaattaacagatctaaatctatgaaaaagggagcatttatggtaatttccataatctctcactttctctagacatttcaaatcaaattgtaataat

SEQ ID NO: 5872 - DNA, 201 bp, Homo sapiens
tgatgattattcctgtctaataaatgtggtatgtctttccatttattccagttgtcttctgtatcttttaatagtatggttatcttaaggtgttttctctytttattttaattggatgtagaatcttcagtaatatcatctagcaagttatttgcatattgtacagttgtatgatgataaatttgtatgttatttctggca

SEQ ID NO: 5873 - DNA, 201 bp, Homo sapiens
aatttggagagttcgagcacgattaattttgtgtgttcagctcaaaggaaaaagcttcctcataggagaaatgcattaatggatgagcgaatgaataagargctttataacccaaccaaccagaagccgaggggctcactatattaaattataccagctctcaatacaatgggtcaaaatgtattttattttaaattctaa

SEQ ID NO: 5874 - DNA, 201 bp, Homo sapiens
agtcagttaccagggaactcacaaaatttggagagttcgagcacgattaattttgtgtgttcagctcaaaggaaaaagcttcctcataggagaaatgcatkaatggatgagcgaatgaataagaagctttataacccaaccaaccagaagccgaggggctcactatattaaattataccagctctcaatacaatgggtcaa

SEQ ID NO: 5875 - DNA, 201 bp, Homo sapiens
ttcgaggtcagtttattcacattctgagcagtggtttacttttagcaaaatattacccatgtcattaaattaatatttgggtttgaatctttttgttttakatgcacttaatgtgtaaaatcatttaacttacagttgtaaaagatctgcaagcgtaaaaaattgacacctaggccttataaggctgtaggtatttaagta

SEQ ID NO: 5876 - DNA, 201 bp, Homo sapiens
aaaaatgcctattactccaatcctgtactcacttgctccctgccagagacaacacaaagagatgagtatacacactcaggaaaacttcgcccgggccttcsaggtagggcgaggactgtgcaccacacgagatgacttgaaaacctgtaggaaggttgtatctcagtgccacttgctttgaggagactcactgggtaactg

SEQ ID NO: 5877 - DNA, 201 bp, Homo sapiens
ggaaatgtagtgacattaaccaaacacacaaagccatctcaagcctaaaaatgcctattactccaatcctgtactcacttgctccctgccagagacaacayaaagagatgagtatacacactcaggaaaacttcgcccgggccttcgaggtagggcgaggactgtgcaccacacgagatgacttgaaaacctgtaggaagg

SEQ ID NO: 5878 - DNA, 201 bp, Homo sapiens
tctcaattaccttagatgaaaaactgccttgcccacctgggagcatcattatcttatcatagaatgaagttactttcacagtgatgaccctgagtattgasaaaaagttggattatgttcattatattctttttaatgcaagcaatgtaaaacgtcctttagaaatgtttcctttaaaaattatttaaattgtattgctta

SEQ ID NO: 5879 - DNA, 201 bp, Homo sapiens
ccatctcaagcctaaaaatgcctattactccaatcctgtactcacttgctccctgccagagacaacacaaagagatgagtatacacactcaggaaaacttygcccgggccttcgaggtagggcgaggactgtgcaccacacgagatgacttgaaaacctgtaggaaggttgtatctcagtgccacttgctttgaggagact

SEQ ID NO: 5880 - DNA, 201 bp, Homo sapiens
ggaagggaaaaaccagaagcgcacaggccatttagcgcaatgtagcgcgtctcacaccagaagttgtttacacactcttggacgcctgagttctccttgayttttgtttttcttcattttatctatcttcgtttatccatcttctagttcatctacttaaccttcttgtaactcagtgctgccaagtggattcggcatcag

SEQ ID NO: 5881 - DNA, 201 bp, Homo sapiens
cacttctagtcttggctcctgagccccaggtactctattcctgaagatccttgcagatatcaatcatcccaagaatgggctagtggtttccgggtttcatraataaagctgtcccattctcatcactaatcaaggtaagagagttacatcttatttctctgccttggtttcatcatctatggaagagcagtcatactggat

SEQ ID NO: 5882 - DNA, 201 bp, Homo sapiens
tctaatttagtcaaacactaccctctctttctccaaaataattattcttaatttatttcacctaacttctgttttttacatcttagcaatgtgaccaccaraagctggagcaactgctttctgattcagaaaataaaagtttattctgatttttatttctgtcttccatacagtcagttaccagggaactcacaaaatttg

SEQ ID NO: 5883 - DNA, 201 bp, Homo sapiens
attactccaatcctgtactcacttgctccctgccagagacaacacaaagagatgagtatacacactcaggaaaacttcgcccgggccttcgaggtagggcsaggactgtgcaccacacgagatgacttgaaaacctgtaggaaggttgtatctcagtgccacttgctttgaggagactcactgggtaactgtttgagggtg

SEQ ID NO: 5884 - DNA, 201 bp, Homo sapiens
gaatgaagttactttcacagtgatgaccctgagtattgagaaaaagttggattatgttcattatattctttttaatgcaagcaatgtaaaacgtcctttakaaatgtttcctttaaaaattatttaaattgtattgcttaaaaaatatgactctttcaactcagttatcacttaaggtttcctggaatattctgctgttta

SEQ ID NO: 5885 - DNA, 201 bp, Homo sapiens
aaaatttggagagttcgagcacgattaattttgtgtgttcagctcaaaggaaaaagcttcctcataggagaaatgcattaatggatgagcgaatgaataasaagctttataacccaaccaaccagaagccgaggggctcactatattaaattataccagctctcaatacaatgggtcaaaatgtattttattttaaattct

SEQ ID NO: 5886 - DNA, 201 bp, Homo sapiens
tttagaacatatttgtaggatatgaaattacctacgtatgtgactcttataagaccagagaaaaaggctagaattatatatatatatatatgaaaatagcrtcagcaattccacaaggccatcaacttggggtatgaactatccgtgaaggactagtgatggctgaacttcaaccacactctgaacagcataaaaatgaga

SEQ ID NO: 5887 - DNA, 201 bp, Homo sapiens
acaatgggtcaaaatgtattttattttaaattctaagttaggctccaaactttacatcgggaccttgtaagacgagatcttttatcatgctagacttttaytatcccctaggaaatgtagtgacattaaccaaacacacaaagccatctcaagcctaaaaatgcctattactccaatcctgtactcacttgctccctgcca

SEQ ID NO: 5888 - DNA, 201 bp, Homo sapiens
aaagagatgagtatacacactcaggaaaacttcgcccgggccttcgaggtagggcgaggactgtgcaccacacgagatgacttgaaaacctgtaggaaggytgtatctcagtgccacttgctttgaggagactcactgggtaactgtttgagggtggctctaatgctctgcaacagtccctgcagggacaaagagaaattt

SEQ ID NO: 5889 - DNA, 201 bp, Homo sapiens
ccctaggaaatgtagtgacattaaccaaacacacaaagccatctcaagcctaaaaatgcctattactccaatcctgtactcacttgctccctgccagagayaacacaaagagatgagtatacacactcaggaaaacttcgcccgggccttcgaggtagggcgaggactgtgcaccacacgagatgacttgaaaacctgtag

SEQ ID NO: 5890 - DNA, 201 bp, Homo sapiens
cacatttaacgcctccctcacgcatcactcaactgactggcaagccaccccttccccttcgactctcttccaaaaatgcttacgaacttgaaatccagcaraaaaggggccacagtgactacgtactcatgattctgttttactcttctaaattcacggtctacttactattaacttatatacacgttaatatttaagttc

SEQ ID NO: 5891 - DNA, 201 bp, Homo sapiens
cagaaatggggccatcctggagaatcatgatgctgttaactgagctacatggaaggcgcagttttcctcctcttatcactggtcttttccttctcacactmagcaatctgagcaccacggggggcaacacctgctctctaatacagaagagatgggtgtatacctccattctaatacagaatgtctccatatacccagcca

SEQ ID NO: 5892 - DNA, 201 bp, Homo sapiens
ttaacattgtccctatgccatctcaccccccatataagctctctgctaactttccaacacagagaacaaaatccaaattcttcaccatggctccagggccmatgtgatctaatagccctctctgcctgtcactcaccaggctccagccacccaacctcatctcatcctcctcactggacatcccacgtgcatcctgtgtgc

SEQ ID NO: 5893 - DNA, 201 bp, Homo sapiens
cgaagtcctcaccgtggcctccagggccctacataactgactcagtttaccccatcccccaccaagatgcaccaagctctccaagctcctcgcctttcccytccctttcctttaggtcttcgtccaaatgtcacctctctagagaccttctctgaataccctacgtaaaaaggtacccggatacctgcctggcaccacgta

SEQ ID NO: 5894 - DNA, 201 bp, Homo sapiens
caattattaagtaaattaagtcatatgttagaaaataagtgctgtggcaaaatccagattaaaatcaccaatcactagtcaggagaccccatcagctacgsaaagaccatacaggtagtgtgcagagacaccagagaggtcaccctgtttgatcgacaaaagtatgctcattagaaggtaaaccacaggactatggggtct

SEQ ID NO: 5895 - DNA, 201 bp, Homo sapiens
aggtagtgtgcagagacaccagagaggtcaccctgtttgatcgacaaaagtatgctcattagaaggtaaaccacaggactatggggtctttatctcttttytccctgcaggattctcagctcaagaagagcacctggcacaggtcagggactcagaagcatttgttgaagaaatggaagtgctcacccactgagttcttgc

SEQ ID NO: 5896 - DNA, 201 bp, Homo sapiens
ctactaacgccagcacatgctgtgatgggattcccccagcagtgcccacacgatgctgggcccacacagcctgtgacacctgctggccacttcgctcccayggagaagcctctttcacgttcatatgtgctggggatctgtgtctgctgagagctgagctgcctgcctgggatcagccagatggagcaggcagagacggca

SEQ ID NO: 5897 - DNA, 201 bp, Homo sapiens
aagagggagttcttaacctctgtggcagagcaacctgaaaacagaattatactccatatacatagctacaatgcctcatgcagaatgctcttcccaaaacygtgctcaaggatacaaacccaggctgtccaatttggggaaatcattgtttgagggtggcacagacaagcagtcggcttggggtttgctccctgtgcacag

SEQ ID NO: 5898 - DNA, 201 bp, Homo sapiens
gaagagcacctggcacaggtcagggactcagaagcatttgttgaagaaatggaagtgctcacccactgagttcttgcttctgcagcattcctggcaggtaaccctctcgagttggctgaaatctttccaagaatgaaaagctgggcttttacaacaaactaacaagcaaaccccaaccaaccacccccacacacccccagg

SEQ ID NO: 5899 - DNA, 201 bp, Homo sapiens
ctgtgtctgctgagagctgagctgcctgcctgggatcagccagatggagcaggcagagacggcacggaccacactccagaggaacacgccatggatggctrtattgttgatgtttcagatatccaaaaagtaaattataaatcttagcggtgatttagctatcctatttgccaaaggtagtttacacgggtgtttcaaatt

SEQ ID NO: 5900 - DNA, 201 bp, Homo sapiens
acatccagtgtgaacatgcattcagcaaacatttcctgagccctgctttgtgccaggctgttctcagtgctcaggatacacaaggaagaaataaataaaarataaggtttctgtccttgtaaagcttatattcgtgtccgtgtgtgcatgcctgtgtgtatgtataagaatacattcaatagacacaattattaagtaaat

SEQ ID NO: 5901 - DNA, 201 bp, Homo sapiens
aaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaagc

SEQ ID NO: 5902 - DNA, 201 bp, Homo sapiens
gaaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaag

SEQ ID NO: 5903 - DNA, 201 bp, Homo sapiens
cagagggaaacaattgaaacagacaatcgctcagataccaacaccaagttcgcctccccttgagaagtttgctgcagtctcctggtctaatccaaataggyggagggagggctgggagggcatcctgcagagctgttcagtggcggttctaacgctaacacccagcgtgttattaaaggaattcccatctgctgagtcaca

SEQ ID NO: 5904 - DNA, 201 bp, Homo sapiens
tgtctgctgagagctgagctgcctgcctgggatcagccagatggagcaggcagagacggcacggaccacactccagaggaacacgccatggatggctataytgttgatgtttcagatatccaaaaagtaaattataaatcttagcggtgatttagctatcctatttgccaaaggtagtttacacgggtgtttcaaattact

SEQ ID NO: 5905 - DNA, 201 bp, Homo sapiens
agaagagcacctggcacaggtcagggactcagaagcatttgttgaagaaatggaagtgctcacccactgagttcttgcttctgcagcattcctggcaggtmaccctctcgagttggctgaaatctttccaagaatgaaaagctgggcttttacaacaaactaacaagcaaaccccaaccaaccacccccacacacccccag

SEQ ID NO: 5906 - DNA, 201 bp, Homo sapiens
tgtgcacagctcgatcatcaaggaaaggcctcttccgggcctcaaagctccctttgtgaggaatgaggcccactgtcgaggctcacacaggcagctgtaaycaggctgcccctctctctgggtgtttgttttgatagaggttcatttatgccagagacaatgcccgctctctttgttctgcccccagcaggaagcagtgca

SEQ ID NO: 5907 - DNA, 201 bp, Homo sapiens
acaactgatcctccctttcatttttagagtaacaaacccagcttgtactacccatgcctacaacagcccagatgtggcactcaaggttgaaaaggggccayaacttggtaacgggacacacatgaccccatgcaggagaacagccagggccatgaggaaagggactttggtgcacaatggcaggtacctatgcccttgctg

SEQ ID NO: 5908 - DNA, 201 bp, Homo sapiens
aaagcaggtgtggcatttatcagtgctgctgtcatccatagagaagccaggaacaacgaaatgtaactctgtgtacacagaactctgccaccccacacagrgcagatggggcagccatcagaaatgcggggcatggacccaaacgccagcatagcaccacacccccaaatgaggggggaacaggctcagcaccccaagaca

SEQ ID NO: 5909 - DNA, 201 bp, Homo sapiens
cccacggagaagcctctttcacgttcatatgtgctggggatctgtgtctgctgagagctgagctgcctgcctgggatcagccagatggagcaggcagagayggcacggaccacactccagaggaacacgccatggatggctatattgttgatgtttcagatatccaaaaagtaaattataaatcttagcggtgatttagct

SEQ ID NO: 5910 - DNA, 201 bp, Homo sapiens
aaaacccagtgtggtcgtctctgttctcaatgtctaccttggaagagggagttcttaacctctgtggcagagcaacctgaaaacagaattatactccatayacatagctacaatgcctcatgcagaatgctcttcccaaaactgtgctcaaggatacaaacccaggctgtccaatttggggaaatcattgtttgagggtgg

SEQ ID NO: 5911 - DNA, 201 bp, Homo sapiens
ccagccatttctagggaaaatcatctctgacagctggcatgaaatcaatgtccacctgaaaagtacctttgagggccatctaataaaggccaaaactatgsccacgaatccaaaactgcggaagtctagactggcgtttctaaataagctagagaaaaatactcaatgtgcgacatcttgtaaactcacagctgctgaaga

SEQ ID NO: 5912 - DNA, 201 bp, Homo sapiens
agagttttgtgaacagaagtatttagaggaagcctgtggggcttgtgggtagggctggtctggtctccagaggacccaaaatcgaggttggagttgagatkggggcaggcctggtgtcctggctgctcatgggccccactggggttacatgtgtgtctcccttaggctgcccatgggccccgggggctgaagggagagaag

SEQ ID NO: 5913 - DNA, 201 bp, Homo sapiens
agagatattggtctgtagttttcttttttattatgtcctttcctggttttggtattagggcgatcctggcttcatagaataatttagggaggattctctcyttctctgttttggaatagtttcagtaggattggtaccaattctcttctttgaatgtctgattgaattcagctgtgagtccatgtgaatctgtgatttttt

SEQ ID NO: 5914 - DNA, 201 bp, Homo sapiens
ggttggagttgagatgggggcaggcctggtgtcctggctgctcatgggccccactggggttacatgtgtgtctcccttaggctgcccatgggccccggggkctgaagggagagaagagagagcctgcagtgctggaacctgtaagtcatgctggtcacagggctgaggtggtggaaagaggagaagcaagtggggtttagt

SEQ ID NO: 5915 - DNA, 201 bp, Homo sapiens
accctgctgctgcatcccacacctcctgctcttggcacccgtgagcttctgctgcctttcctttatgctgctgtctgggtctttggggttgatgtgggatmtgggagaattttgaaacggatcattgctgtcaggatgaaggtggagaggggcattctgaagatctttgttttggggagttggggtggtggtgaatgtttc

SEQ ID NO: 5916 - DNA, 201 bp, Homo sapiens
tgttttgtgcctttcttttcactctgggtcatggtagccatattgttgaaggttcacttcccagatcctcttttcttggctgcttcctgtctgtacagccrcttcctgtttgtccagtttgttttgtggccatcttggccatgtttaattttccttggccctggcatcactcttgcatccaagtgtttgtcattttatttt

SEQ ID NO: 5917 - DNA, 201 bp, Homo sapiens
tcacagggctgaggtggtggaaagaggagaagcaagtggggtttagtgtgctggccctgtcacctgtgagttttaacctttgactccacagggtatgctcktggaggggccccctggtttagaaggccctgtggtgagtctagcagtgacctggtggccattgttttcttagagatccctcctatgtgttcatctgtgcct

SEQ ID NO: 5918 - DNA, 201 bp, Homo sapiens
tgttttgtggccatcttggccatgtttaattttccttggccctggcatcactcttgcatccaagtgtttgtcattttattttgtgtcccttagttgttctmatatcttccagtattctctgtcagttggactgcttcctgtctactctgctacatcttctgcctgccttgcagttatggctgccttttctaccctgctgct

SEQ ID NO: 5919 - DNA, 201 bp, Homo sapiens
tgaggtggtggaaagaggagaagcaagtggggtttagtgtgctggccctgtcacctgtgagttttaacctttgactccacagggtatgctcgtggaggggmcccctggtttagaaggccctgtggtgagtctagcagtgacctggtggccattgttttcttagagatccctcctatgtgttcatctgtgccttccccacat

SEQ ID NO: 5920 - DNA, 201 bp, Homo sapiens
ctgttttgtgcctttcttttcactctgggtcatggtagccatattgttgaaggttcacttcccagatcctcttttcttggctgcttcctgtctgtacagcyacttcctgtttgtccagtttgttttgtggccatcttggccatgtttaattttccttggccctggcatcactcttgcatccaagtgtttgtcattttattt

SEQ ID NO: 5921 - DNA, 201 bp, Homo sapiens
gtggcaggactgtccacagccacttattctatccttcagtcttcatctctccatctatccatcccttgaacctatctctctcctcatccaccccatccatycactcattcaccagtccacctacgcacacatccaccacccactcccgcaaccatttacccacctatgcatcacaaacttacccatctactcatgcatgaa

SEQ ID NO: 5922 - DNA, 201 bp, Homo sapiens
atgagggccagaagaagggcaaagcatcctgctgggagaggaactgtggggtgcattgtagggggctgctctggggcttggataactgagcccaagaactrtatgttttgcaaaaggcagttatgaggcctgagtttggaatatctctgggaaatgctctccaaatttacttggagtatggatacttaacctgtgcagggt

SEQ ID NO: 5923 - DNA, 201 bp, Homo sapiens
ccctcctatgtgttcatctgtgccttccccacatatgctcaggcctcctcctcagaactccggagggtccttccaataaaagttttttaaaaaatcatttygaaaaattaattcaatagtttttggggagcaggtggtgtttggttatatggataagttctttagtggtgatttctgaggttttggtgcacccatcacctg

SEQ ID NO: 5924 - DNA, 201 bp, Homo sapiens
cattgtacctgttttgtgcctttcttttcactctgggtcatggtagccatattgttgaaggttcacttcccagatcctcttttcttggctgcttcctgtckgtacagccacttcctgtttgtccagtttgttttgtggccatcttggccatgtttaattttccttggccctggcatcactcttgcatccaagtgtttgtca

SEQ ID NO: 5925 - DNA, 201 bp, Homo sapiens
cacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatcgctgtactgttttccataggttgtactagttta

SEQ ID NO: 5926 - DNA, 201 bp, Homo sapiens
atccattatccttcctggaactcaaccactctctccttcaatacactcatgcacccatctcctcacccactcacttcacatccaaccgttcactcaaccaygtattcaattccacccatctatctattcactcatctgattccatctactctgtacctcccgctcatctacccactaagccttgcatgcataattccctct

SEQ ID NO: 5927 - DNA, 201 bp, Homo sapiens
ctagttttgccctctgccttgtgatcttttactgccctctgaagcatgtgatccctgtgacccattccctattcatagacccccaccccttttgaaatccrtaataaaaacttgctggttttgcggctcaggtgggcatcatggaacctgctgacatgtgatatcacccccggagacccagctgtaaatttctctcttttg

SEQ ID NO: 5928 - DNA, 201 bp, Homo sapiens
catgtgtgtgcaagtgtctttttcatacaatggcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacgtctattttttttttt

SEQ ID NO: 5929 - DNA, 201 bp, Homo sapiens
acccatctatccattatccttcctggaactcaaccactctctccttcaatacactcatgcacccatctcctcacccactcacttcacatccaaccgttcaytcaaccatgtattcaattccacccatctatctattcactcatctgattccatctactctgtacctcccgctcatctacccactaagccttgcatgcataa

SEQ ID NO: 5930 - DNA, 201 bp, Homo sapiens
ttgctgtcaggatgaaggtggagaggggcattctgaagatctttgttttggggagttggggtggtggtgaatgtttcaccttctccccacccttatcttgsctatggcctggatttgggaacaggcatctgaatggaggtgtgcaagggagggaactggttggcttggagtgtacatgagggccagaagaagggcaaagca

SEQ ID NO: 5931 - DNA, 201 bp, Homo sapiens
ctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtca

SEQ ID NO: 5932 - DNA, 201 bp, Homo sapiens
tgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatctgggagaattttgaaacggatcattgctgtcaggatgaagg

SEQ ID NO: 5933 - DNA, 201 bp, Homo sapiens
gttctttaaggcatcgctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgt

SEQ ID NO: 5934 - DNA, 201 bp, Homo sapiens
aggatttttgcatctattttcatcagagatattggtctgtagttttcttttttattatgtcctttcctggttttggtattagggcgatcctggcttcataraataatttagggaggattctctccttctctgttttggaatagtttcagtaggattggtaccaattctcttctttgaatgtctgattgaattcagctgtga

SEQ ID NO: 5935 - DNA, 201 bp, Homo sapiens
ttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctgg

SEQ ID NO: 5936 - DNA, 201 bp, Homo sapiens
taccttttcttttttggagaaagactgaaagactcaaagtcctctttctgaaagaggctcttcaggatttggagaggttgtgtttgctgaggtgggactgrgaactggggtgcagggaaccctgagatctccttggcaggcatgagagttttgtgaacagaagtatttagaggaagcctgtggggcttgtgggtagggctg

SEQ ID NO: 5937 - DNA, 201 bp, Homo sapiens
ttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagctctgtaaagaatgatgatggcattttgatggggattgcat

SEQ ID NO: 5938 - DNA, 201 bp, Homo sapiens
aaaaatcattttgaaaaattaattcaatagtttttggggagcaggtggtgtttggttatatggataagttctttagtggtgatttctgaggttttggtgcrcccatcacctgaggaatgtacactgtatccagtgtgtagtcttttatcccttacccagctcctactcatacctggaagtcctcaaagtccattatataat

SEQ ID NO: 5939 - DNA, 201 bp, Homo sapiens
ttccagcctggcaaattctagtcatactggttctctgctctcgaaccctgtttcctgttaagatgtttatcaatgacaatgtgtgcccagcgggatgtggmacctcatcagtgattctagttttgccctctgccttgtgatcttttactgccctctgaagcatgtgatccctgtgacccattccctattcatagaccccca

SEQ ID NO: 5940 - DNA, 201 bp, Homo sapiens
aaaaattaattcaatagtttttggggagcaggtggtgtttggttatatggataagttctttagtggtgatttctgaggttttggtgcacccatcacctgasgaatgtacactgtatccagtgtgtagtcttttatcccttacccagctcctactcatacctggaagtcctcaaagtccattatataattcttatgcctttg

SEQ ID NO: 5941 - DNA, 201 bp, Homo sapiens
aacctcatcagtgattctagttttgccctctgccttgtgatcttttactgccctctgaagcatgtgatccctgtgacccattccctattcatagacccccrccccttttgaaatccataataaaaacttgctggttttgcggctcaggtgggcatcatggaacctgctgacatgtgatatcacccccggagacccagctgt

SEQ ID NO: 5942 - DNA, 201 bp, Homo sapiens
gtaatgtgatgctccagatttattcgttttgcttaatcttactttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttcc

SEQ ID NO: 5943 - DNA, 201 bp, Homo sapiens
gaacctcatcagtgattctagttttgccctctgccttgtgatcttttactgccctctgaagcatgtgatccctgtgacccattccctattcatagaccccyaccccttttgaaatccataataaaaacttgctggttttgcggctcaggtgggcatcatggaacctgctgacatgtgatatcacccccggagacccagctg

SEQ ID NO: 5944 - DNA, 201 bp, Homo sapiens
agtgccctcaggcttgctaggattaggaaattccagcctggcaaattctagtcatactggttctctgctctcgaaccctgtttcctgttaagatgtttatyaatgacaatgtgtgcccagcgggatgtggaacctcatcagtgattctagttttgccctctgccttgtgatcttttactgccctctgaagcatgtgatccc

SEQ ID NO: 5945 - DNA, 201 bp, Homo sapiens
agcttgtattttgttgaggatttttgcatctattttcatcagagatattggtctgtagttttcttttttattatgtcctttcctggttttggtattagggygatcctggcttcatagaataatttagggaggattctctccttctctgttttggaatagtttcagtaggattggtaccaattctcttctttgaatgtctga

SEQ ID NO: 5946 - DNA, 201 bp, Homo sapiens
tcctatgcctgtctttactttaatctcttaatcctgtcatctttgtaagctgaagatgtatgtcacctcaggaccctgtgatgattgcgttaactgcatarattgtttgtaaagcatgtgtgtttgaacaatatgaaaactgggcaccttgaaaagaacaggataacagcaattttcagggaacaagggagataaccataa

SEQ ID NO: 5947 - DNA, 201 bp, Homo sapiens
cctgcagtgccctcaggcttgctaggattaggaaattccagcctggcaaattctagtcatactggttctctgctctcgaaccctgtttcctgttaagatgyttatcaatgacaatgtgtgcccagcgggatgtggaacctcatcagtgattctagttttgccctctgccttgtgatcttttactgccctctgaagcatgtg

SEQ ID NO: 5948 - DNA, 201 bp, Homo sapiens
gtctccagaggacccaaaatcgaggttggagttgagatgggggcaggcctggtgtcctggctgctcatgggccccactggggttacatgtgtgtctccctyaggctgcccatgggccccgggggctgaagggagagaagagagagcctgcagtgctggaacctgtaagtcatgctggtcacagggctgaggtggtggaaag

SEQ ID NO: 5949 - DNA, 201 bp, Homo sapiens
gtgcataagggcatataccttttcttttttggagaaagactgaaagactcaaagtcctctttctgaaagaggctcttcaggatttggagaggttgtgtttsctgaggtgggactgagaactggggtgcagggaaccctgagatctccttggcaggcatgagagttttgtgaacagaagtatttagaggaagcctgtggggc

SEQ ID NO: 5950 - DNA, 201 bp, Homo sapiens
cacacctcctgctcttggcacccgtgagcttctgctgcctttcctttatgctgctgtctgggtctttggggttgatgtgggatctgggagaattttgaaayggatcattgctgtcaggatgaaggtggagaggggcattctgaagatctttgttttggggagttggggtggtggtgaatgtttcaccttctccccaccctt

SEQ ID NO: 5951 - DNA, 201 bp, Homo sapiens
cagggctgaggtggtggaaagaggagaagcaagtggggtttagtgtgctggccctgtcacctgtgagttttaacctttgactccacagggtatgctcgtgraggggccccctggtttagaaggccctgtggtgagtctagcagtgacctggtggccattgttttcttagagatccctcctatgtgttcatctgtgccttcc

SEQ ID NO: 5952 - DNA, 201 bp, Homo sapiens
actcccgcaaccatttacccacctatgcatcacaaacttacccatctactcatgcatgaaggcttatatccactcacctgtccatcctccccctgcttaaygactctccccttctttacacacatctattcgactatgcttttgttcatctgtcctcttcaacttatccatccatctattcactcacccacccactcacac

SEQ ID NO: 5953 - DNA, 201 bp, Homo sapiens
gagatgggggcaggcctggtgtcctggctgctcatgggccccactggggttacatgtgtgtctcccttaggctgcccatgggccccgggggctgaagggaragaagagagagcctgcagtgctggaacctgtaagtcatgctggtcacagggctgaggtggtggaaagaggagaagcaagtggggtttagtgtgctggccc

SEQ ID NO: 5954 - DNA, 201 bp, Homo sapiens
ctctggggcttggataactgagcccaagaactgtatgttttgcaaaaggcagttatgaggcctgagtttggaatatctctgggaaatgctctccaaatttmcttggagtatggatacttaacctgtgcagggtttttacatttttgaactccttcaaattctaaataaaattttgtgcataagggcatataccttttcttt

SEQ ID NO: 5955 - DNA, 201 bp, Homo sapiens
tttactgatttgtctgattgctctggctaggatttccagtactatgttgaatagaagtggtgagagtgggcatccttatcttgttccagttctcagggggwatgctttgaacttttccccgttcagtataaggtcggctgtgggtttgtcatagatggtttttattaccttaagttatgatctttgtatgtcaagtttgct

SEQ ID NO: 5956 - DNA, 201 bp, Homo sapiens
ttcctatcttcaggactgctgatctctgcagaataactagatgtccacttatgtggcaggactgtccacagccacttattctatccttcagtcttcatctytccatctatccatcccttgaacctatctctctcctcatccaccccatccatccactcattcaccagtccacctacgcacacatccaccacccactcccgc

SEQ ID NO: 5957 - DNA, 201 bp, Homo sapiens
ttattctatccttcagtcttcatctctccatctatccatcccttgaacctatctctctcctcatccaccccatccatccactcattcaccagtccacctaygcacacatccaccacccactcccgcaaccatttacccacctatgcatcacaaacttacccatctactcatgcatgaaggcttatatccactcacctgtcc

SEQ ID NO: 5958 - DNA, 201 bp, Homo sapiens
ctgtttcctgttaagatgtttatcaatgacaatgtgtgcccagcgggatgtggaacctcatcagtgattctagttttgccctctgccttgtgatcttttaytgccctctgaagcatgtgatccctgtgacccattccctattcatagacccccaccccttttgaaatccataataaaaacttgctggttttgcggctcagg

SEQ ID NO: 5959 - DNA, 201 bp, Homo sapiens
ctgaatggaggtgtgcaagggagggaactggttggcttggagtgtacatgagggccagaagaagggcaaagcatcctgctgggagaggaactgtggggtgyattgtagggggctgctctggggcttggataactgagcccaagaactgtatgttttgcaaaaggcagttatgaggcctgagtttggaatatctctgggaaa

SEQ ID NO: 5960 - DNA, 201 bp, Homo sapiens
atctttgtaagctgaagatgtatgtcacctcaggaccctgtgatgattgcgttaactgcataaattgtttgtaaagcatgtgtgtttgaacaatatgaaawctgggcaccttgaaaagaacaggataacagcaattttcagggaacaagggagataaccataaggtctgactgcctgcagggccaggcagaacagagtcat

SEQ ID NO: 5961 - DNA, 201 bp, Homo sapiens
agggaactggttggcttggagtgtacatgagggccagaagaagggcaaagcatcctgctgggagaggaactgtggggtgcattgtagggggctgctctggrgcttggataactgagcccaagaactgtatgttttgcaaaaggcagttatgaggcctgagtttggaatatctctgggaaatgctctccaaatttacttgga

SEQ ID NO: 5962 - DNA, 201 bp, Homo sapiens
ggccccactggggttacatgtgtgtctcccttaggctgcccatgggccccgggggctgaagggagagaagagagagcctgcagtgctggaacctgtaagtyatgctggtcacagggctgaggtggtggaaagaggagaagcaagtggggtttagtgtgctggccctgtcacctgtgagttttaacctttgactccacaggg

SEQ ID NO: 5963 - DNA, 201 bp, Homo sapiens
ccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggtcattgggtttgctccccttgctgctgctccatccctgcaggaggc

SEQ ID NO: 5964 - DNA, 201 bp, Homo sapiens; identical to SEQ ID NO: 2344

SEQ ID NO: 5965 - DNA, 201 bp, Homo sapiens
gccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaa

SEQ ID NO: 5966 - DNA, 201 bp, Homo sapiens; identical to SEQ ID NO: 2260

SEQ ID NO: 5967 - DNA, 201 bp, Homo sapiens; identical to SEQ ID NO: 2279

SEQ ID NO: 5968 - DNA, 201 bp, Homo sapiens; identical to SEQ ID NO: 2332

SEQ ID NO: 5969 - DNA, 201 bp, Homo sapiens; identical to SEQ ID NO: 2650

SEQ ID NO: 5970 - DNA, 201 bp, Homo sapiens
agctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagccca

SEQ ID NO: 5971 - DNA, 201 bp, Homo sapiens; identical to SEQ ID NO: 2274

SEQ ID NO: 5972 - DNA, 201 bp, Homo sapiens; identical to SEQ ID NO: 2335

SEQ ID NO: 5973 - DNA, 201 bp, Homo sapiens
tggaacgagcctcctccttggaagatggaagaccgtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatga

SEQ ID NO: 5974 - DNA, 201 bp, Homo sapiens
taaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctcct

SEQ ID NO: 5975 - DNA, 201 bp, Homo sapiens
accatctctgtgcgaatccccagggtaaaggcgtgggtcattgggtttgctccccttgctgctgctccatccctgcaggaggctcgcgctgaggcaggacygtgcggccatggctgctgcattcattgagcacaaaggtgcagctgcagcagcagctggagagcaagagtcacccagcctgtgcgccagaatgcagaggct

SEQ ID NO: 5976 - DNA, 201 bp, Homo sapiens
gaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtacgaaaagtggcttcgtaaaatagaagagcagtca

SEQ ID NO: 5977 - DNA, 201 bp, Homo sapiens; identical to SEQ ID NO: 2337

SEQ ID NO: 5978 - DNA, 201 bp, Homo sapiens
catttcgtccttaagagagcagtggttcctcaggttctgaggagaggaaggtgtccaggcagcaccatctctgtgcgaatccccagggtaaaggcgtgggkcattgggtttgctccccttgctgctgctccatccctgcaggaggctcgcgctgaggcaggaccgtgcggccatggctgctgcattcattgagcacaaagg

SEQ ID NO: 5979 - DNA, 201 bp, Homo sapiens
ctgaggagaggaaggtgtccaggcagcaccatctctgtgcgaatccccagggtaaaggcgtgggtcattgggtttgctccccttgctgctgctccatcccygcaggaggctcgcgctgaggcaggaccgtgcggccatggctgctgcattcattgagcacaaaggtgcagctgcagcagcagctggagagcaagagtcacc

SEQ ID NO: 5980 - DNA, 201 bp, Homo sapiens
ggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtga

SEQ ID NO: 5981 - DNA, 201 bp, Homo sapiens
cttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgacccgccgtggtatgccttggcccattccagcagtcccagtt

SEQ ID NO: 5982 - DNA, 201 bp, Homo sapiens
tctgactccttaccttaggctcctccctaaacaccgaggcgtaaagtaccacgactacacacccaccttccaccaagggacctgagatttctgttaacctytgctgcctctacccccctcagttaggctcccaggaggagtggtcagcgcctggcacttgcaggagcccacaaagcagcgacttcgcctttccagcccccc

SEQ ID NO: 5983 - DNA, 201 bp, Homo sapiens
cccagcccctccgccgggcgtagggccagcacaacgcgtcagggcacagggcctggccagctacaagcgcgcccctcgctgaacggtcccccggtccccamgcggcggtcgcccctgggctctggacagcgaacgggacctcctcctcagcaggggtgccgcgcggcctcaggacggacgcacgcggatcttcgcttcccc

SEQ ID NO: 5984 - DNA, 201 bp, Homo sapiens
ctgctctacttaatactgcctgtgccacagacagaaaaatcccatctcccacccaccagcctccctggaacaaacaccttggctgtctctcgctacctccragtcaggggaacattccaaccaggatggtgctcagagaccccaccttttatagccagagtccctgattcacaccatatgcccaaaggaggcgtgtttcta

SEQ ID NO: 5985 - DNA, 201 bp, Homo sapiens
acacagcccggccctgccttcctggatttcctggcaaagcccaggccttctcacacgcactcagggtgatctgagcagaccacaggctgttcatcccattrggttaaaaagtacttggagacttagttgcagtaaggtcttaggttttgttggggttttttttgtgggaaagtgaaggcatctgcacctgaaatgaaatac

SEQ ID NO: 5986 - DNA, 201 bp, Homo sapiens
atccatgcaaacagacagaggcatttaaaaaatatggtatttaatgatttaatgtcagtatcatacaagaatctatggatatttcttaaatgctcccaaayaccaaacttgcaaacaaaataaattcagtttcggaaccaaataaatagagtttacatatgactagggtgactccactggcaccccgatatagacatatgt

SEQ ID NO: 5987 - DNA, 201 bp, Homo sapiens
tccctgaagtgataaagagttagaaccagacacacacttctgcattcagctgctgtctttccttgtgagtggaaaaacacactcagtacattctctgcaaycctgcttaaaacctcttctaaagcttctttgacacagttattcaaaagcttctaaaagtagtatcgacgtattacaaaataatccaatcatttcaagttc

SEQ ID NO: 5988 - DNA, 201 bp, Homo sapiens
gtcatcactgcacagccaccagtacacctcgaagccaattaatcctgcaaaacaaattcctctcaaaatggcagtctgttaggtcaagtttggctgttttrttaatcgcctatcaacagaaacagctttgctaggcacacccagaagttcatctctcctcatcacccacctttggcacccagtgacttttccaaggaggat

SEQ ID NO: 5989 - DNA, 201 bp, Homo sapiens
atggccaggggtaaggcaggggtgggaggaggaagggcaggagacccaacggatggtgctgcctggacagtccctgaagtgataaagagttagaaccagayacacacttctgcattcagctgctgtctttccttgtgagtggaaaaacacactcagtacattctctgcaatcctgcttaaaacctcttctaaagcttcttt

SEQ ID NO: 5990 - DNA, 201 bp, Homo sapiens
actggagggattttgcgactggagttacaggaggctgaggagctggcatctgaaagtccatgcttcacgcttttcaaatgcactatgtataaccaagctcrtttccaaaaacagaatctgaactagctcataataaaccattcaccttttattttttgctgaaggggtcagagcatcatcccaattaccatttctctctaa

SEQ ID NO: 5991 - DNA, 201 bp, Homo sapiens
gagaaaattatacattctcagaattccattcataaaggactactggtcacaaaagaatggccaggggtaaggcaggggtgggaggaggaagggcaggagayccaacggatggtgctgcctggacagtccctgaagtgataaagagttagaaccagacacacacttctgcattcagctgctgtctttccttgtgagtggaaa

SEQ ID NO: 5992 - DNA, 201 bp, Homo sapiens
taaagaagcattcttctgagaaaattatacattctcagaattccattcataaaggactactggtcacaaaagaatggccaggggtaaggcaggggtgggargaggaagggcaggagacccaacggatggtgctgcctggacagtccctgaagtgataaagagttagaaccagacacacacttctgcattcagctgctgtct

SEQ ID NO: 5993 - DNA, 201 bp, Homo sapiens
agaaatatttggtgagctaaagaagcattcttctgagaaaattatacattctcagaattccattcataaaggactactggtcacaaaagaatggccagggrtaaggcaggggtgggaggaggaagggcaggagacccaacggatggtgctgcctggacagtccctgaagtgataaagagttagaaccagacacacacttct

SEQ ID NO: 5994 - DNA, 201 bp, Homo sapiens
gtctcagcagctgctaaaacacgtccaagcactttgcatctatccggaaatccagaatggcagcctgggttcacagatctgctgccaagggcagatgtatscgcactgcagctgggccctcctccccaggggccccatgggcacaagcagctcagggtgggccagcgagcctcagtcacactggctgccctcagccccacc

SEQ ID NO: 5995 - DNA, 201 bp, Homo sapiens
actgtcccccataagccctcacacctcctaccaagctccaaggactgttctgttcttctgcctactcccgcaatgcagttcaaacgtttaccagggctctrcagtgagctacttttccaaagacagaaaagcaaggctatgtgcaatcagacgaaactccagctctcattgtaacatccagcttaaagccatatgttagcc

SEQ ID NO: 5996 - DNA, 201 bp, Homo sapiens
atctgactagtttccatttgtctctgcattacaactaatacctctgggaggtgggggtgggggtgatcctaattcaaacagtaaggctgcccaggaagtayttctaataatatcaaccttcgtctttccttttttgtactgtaggctctttgtctcctgatcttcttttattttgttccccctttttactactaagcccaa

SEQ ID NO: 5997 - DNA, 201 bp, Homo sapiens
aggaggatctttttcccccctcagcaaacaagaaatatttggtgagctaaagaagcattcttctgagaaaattatacattctcagaattccattcataaasgactactggtcacaaaagaatggccaggggtaaggcaggggtgggaggaggaagggcaggagacccaacggatggtgctgcctggacagtccctgaagtg

SEQ ID NO: 5998 - DNA, 201 bp, Homo sapiens
gacccagctgtccctgtccctcaccagcctcacatgcccaagtcccatgtacccctggggctgccatgctggctgctgagccatgggcgctggtttggagrtgaacttcttcgaggaaagcagcttcttatcccccagaagttctgcagatcatctgtgcactttggtttttacttaaaatgtgatttaaacagcctgctc

SEQ ID NO: 5999 - DNA, 201 bp, Homo sapiens
ctctcaaaatggcagtctgttaggtcaagtttggctgttttgttaatcgcctatcaacagaaacagctttgctaggcacacccagaagttcatctctcctmatcacccacctttggcacccagtgacttttccaaggaggatctttttcccccctcagcaaacaagaaatatttggtgagctaaagaagcattcttctgag

SEQ ID NO: 6000 - DNA, 201 bp, Homo sapiens
actgcacagccaccagtacacctcgaagccaattaatcctgcaaaacaaattcctctcaaaatggcagtctgttaggtcaagtttggctgttttgttaatygcctatcaacagaaacagctttgctaggcacacccagaagttcatctctcctcatcacccacctttggcacccagtgacttttccaaggaggatcttttt

SEQ ID NO: 6001 - DNA, 201 bp, Homo sapiens
gccgagaatgtcacactggcatacacatgaggaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctt

SEQ ID NO: 6002 - DNA, 201 bp, Homo sapiens
aaattctacaatttagaaaagcaatacagaaggaccatttagttatggtagtgaacatatatagtcaacacagcttaagactcagaattttagatggtctyagaatgcaactcttagatagtttaatttaaaaaaaaaatagcagcagctgccaccatttaccaaaaacctatgtgcttggaaacatgttagatgcttttc

SEQ ID NO: 6003 - DNA, 201 bp, Homo sapiens
tcctggatttcctggcaaagcccaggccttctcacacgcactcagggtgatctgagcagaccacaggctgttcatcccattgggttaaaaagtacttggaracttagttgcagtaaggtcttaggttttgttggggttttttttgtgggaaagtgaaggcatctgcacctgaaatgaaataccagaaagcctccacagcaa

SEQ ID NO: 6004 - DNA, 201 bp, Homo sapiens
tgacatcctgaaaacctaacagcggccaagctgaccccgcagaagaagtgatctaacctggatggtcacccttccctgcctaagactcaccctttccaccsgccccagaagcccttattcctccttgacttgaaaagacaactgtcccccataagccctcacacctcctaccaagctccaaggactgttctgttcttctgc

SEQ ID NO: 6005 - DNA, 201 bp, Homo sapiens
aggaaatggaagtacagggcagacaggtgacgtggcaaccgtccctaggaaaggcactgctggacccagctgtccctgtccctcaccagcctcacatgccsaagtcccatgtacccctggggctgccatgctggctgctgagccatgggcgctggtttggaggtgaacttcttcgaggaaagcagcttcttatcccccaga

SEQ ID NO: 6006 - DNA, 201 bp, Homo sapiens
aattaccatttctctctaatgaccacttactcccttcttacacattttcatcagctctttattctacactgagtatttccaagaattaggataacactacygcccaataagatagagttggggttacccaaataagcaacagaagctttccagtgggaccgagtcaagtcaagggtctcaagtccccccaccctaaagcac

SEQ ID NO: 6007 - DNA, 201 bp, Homo sapiens
caacacagcccggccctgccttcctggatttcctggcaaagcccaggccttctcacacgcactcagggtgatctgagcagaccacaggctgttcatcccawtgggttaaaaagtacttggagacttagttgcagtaaggtcttaggttttgttggggttttttttgtgggaaagtgaaggcatctgcacctgaaatgaaat

SEQ ID NO: 6008 - DNA, 201 bp, Homo sapiens
acgtttaccagggctctgcagtgagctacttttccaaagacagaaaagcaaggctatgtgcaatcagacgaaactccagctctcattgtaacatccagcttaaagccatatgttagccagtggcaggtacagattagaacccagaatggtctagattttgggtttctacttggggttccttcttccatataaatgatctct

SEQ ID NO: 6009 - DNA, 201 bp, Homo sapiens
ttagttatggtagtgaacatatatagtcaacacagcttaagactcagaattttagatggtctcagaatgcaactcttagatagtttaatttaaaaaaaaaatagcagcagctgccaccatttaccaaaaacctatgtgcttggaaacatgttagatgcttttcaaatactgtcctattcctgtctcactgaaggaaggtga

SEQ ID NO: 6010 - DNA, 201 bp, Homo sapiens
gtgccacagacagaaaaatcccatctcccacccaccagcctccctggaacaaacaccttggctgtctctcgctacctccaagtcaggggaacattccaacyaggatggtgctcagagaccccaccttttatagccagagtccctgattcacaccatatgcccaaaggaggcgtgtttctaagtgatgcttccaacttcacc

SEQ ID NO: 6011 - DNA, 201 bp, Homo sapiens
tcagtactcctcagtagcaatgacagcaacaatgacacagtaaacatctgcatttcataatcctggtacaactggctcaccgaagactgccaggatacgcyactctctgctcaaggggaaaatgtatcttccgaacaataaatccttcactaagcagatgcagtgcttgcccttggggtgacagcatacagtggaggatac

SEQ ID NO: 6012 - DNA, 201 bp, Homo sapiens
tgtctctgaacaatggaacatagcccaaggctgcaattttgttgcacacattacagtgttttaaggccactggtggcctgttctttgagatgaaaacaatrcatcagtaggaacaaagtgaaagagagtaaactggtctccaggtacccaaacagtatgtgaagtcaacagaggaacacttcctgtggtctattaataatt

SEQ ID NO: 6013 - DNA, 201 bp, Homo sapiens
actgcaacctaacttaggagtattttttttttgtactaacgaggtgagtctcagccaatcacagcagccaagctacagccaatcccatgtggccaactgakcagcctatgcccagtaagacaactgctcacctgtaactactcaagctgcttctggacctcatttccatttgctgtttataagtgctgcctgcccactttg

SEQ ID NO: 6014 - DNA, 201 bp, Homo sapiens
gcatgtggctggtctctagttggctagatagtagtagttaaaatgaaaagaaacacttaatgttagatgccatccaatagggccacctaaagggatggaargttctcaacaacaagagcccagaggtagaagcaagactcttagcggggaaggatggagtcgcaagtgaaaacctagacaaagaagcatctgtcctggtcc

SEQ ID NO: 6015 - DNA, 201 bp, Homo sapiens
tgataaagctaaacctgcatgtggctggtctctagttggctagatagtagtagttaaaatgaaaagaaacacttaatgttagatgccatccaatagggccmcctaaagggatggaaagttctcaacaacaagagcccagaggtagaagcaagactcttagcggggaaggatggagtcgcaagtgaaaacctagacaaagaa

SEQ ID NO: 6016 - DNA, 201 bp, Homo sapiens
tgggtttgcagcgaggagacaccccagggcaaacagcctgaccccagccagggatgtccaagaaaggccgcgactcctgataatcccttatgccccggagygcctcgcctgcagaggcagcgtccccgccacccagccccggctctgccgcggtgaggaccggcgggtcggggtggactggacactgtcccacccatcaaa

SEQ ID NO: 6017 - DNA, 201 bp, Homo sapiens
tcacatgacttgcgctttgcaatgtttaacactgcagtcaaatgactcggcatcctaaagagcgtgttagaggcagggaacgcaatggaggtcactccacygtcactacaaattccgggaaggaaacttccccagattcctccacttggaggtggcgctcggcctcaggctaggagggaacaggtgagaaagcagcccagg

SEQ ID NO: 6018 - DNA, 201 bp, Homo sapiens
agtttggcccaggagcaggtaggaggctcgcctgagaaactgcaggagacatctaactggcttctgtcccagcagcaggctgacggctcgttccaggaccyctctccagtgatacataggagcatgcaggtgcgggcatgctggggctggcccgagaagcgcctgtcggaggactctctttgccccttccccctcctgttt

SEQ ID NO: 6019 - DNA, 201 bp, Homo sapiens
tctcaaaggcaagctcatttttgggggagaaagcaagtgctgggctcctgggtgcccacgcagctgccatcacggcctatgccctgacactgaccaaggcscctgcggacctgcggggtgttgcccacaacaacctcatggcaatggcccaggagactggaggtgaggggtgaggcgctctggcagtgagcctgaggccca

SEQ ID NO: 6020 - DNA, 201 bp, Homo sapiens; identical to SEQ ID NO: 3210

SEQ ID NO: 6021 - DNA, 201 bp, Homo sapiens
cctatgccctgacactgaccaaggcccctgcggacctgcggggtgttgcccacaacaacctcatggcaatggcccaggagactggaggtgaggggtgaggsgctctggcagtgagcctgaggcccaggggaccttaggatccctgagtgtgcccagagggagaggctggatgaagactcagaggaggaatgaagttataag

SEQ ID NO: 6022 - DNA, 201 bp, Homo sapiens
agttataagcaggggtgggttgggggagactcaggagagcccagcagggggtggctaagggccaggggaccaggctcttctccctgccttcctgtttactygtggtctcccttcactttcagataacctgtactggggctcagtcactggttctcagagcaatgccgtgtcgcccaccccggctcctcgcaacccatccga

SEQ ID NO: 6023 - DNA, 201 bp, Homo sapiens
atgagaagcaagtccttatccccaaccctcctttcctgccctccaggctcacagcctttgtgttgaaggtcctgagtttggcccaggagcaggtaggaggmtcgcctgagaaactgcaggagacatctaactggcttctgtcccagcagcaggctgacggctcgttccaggacctctctccagtgatacataggagcatgc

SEQ ID NO: 6024 - DNA, 201 bp, Homo sapiens
tttttccccctgcttgctttcgcttgctctccccatctctgggtacctgttgtttcctttacccgcctcagtgctggtggctccgaatcccactcctcagmccaggcctcttccctgaaccatgggccccactcgtcccactcccacagcacctcagacgaggcatgtcccaaagcccttcttcattctgtgtctcttgtc

SEQ ID NO: 6025 - DNA, 201 bp, Homo sapiens
tggaggaggagctgcaggtgaaccactccctggtgaaccactccctcgcctgggtagccaggacacctgggcctcgtggccaggccagaagccgtccccamcctcccacccgtggaatccccgcagcacttcttcctggggtcttcgggggaagactgacttcctggctgcgtgacctggagctctgagcttcagttttct

SEQ ID NO: 6026 - DNA, 201 bp, Homo sapiens
gcaggtaggaggctcgcctgagaaactgcaggagacatctaactggcttctgtcccagcagcaggctgacggctcgttccaggacctctctccagtgatasataggagcatgcaggtgcgggcatgctggggctggcccgagaagcgcctgtcggaggactctctttgccccttccccctcctgtttgacatcttttctcc

SEQ ID NO: 6027 - DNA, 201 bp, Homo sapiens
ggggtgccaggtgtgagggctgccctcccacctccgctgggaggaacctgaacctgggaaccatgaagctggaagcactgctgtgtccgctttcatgaacmcagcctgggaccagggcatattaaaggcttttggcagcaaagtgtcagtgttggcagcgaagtgtcagtgtgtgttgctagggctgagagcagtgcccct

SEQ ID NO: 6028 - DNA, 201 bp, Homo sapiens
aggtaggaggctcgcctgagaaactgcaggagacatctaactggcttctgtcccagcagcaggctgacggctcgttccaggacctctctccagtgatacayaggagcatgcaggtgcgggcatgctggggctggcccgagaagcgcctgtcggaggactctctttgccccttccccctcctgtttgacatcttttctcccc

SEQ ID NO: 6029 - DNA, 201 bp, Homo sapiens
gtgttcatgaatcgagagcccaagaggaccctgacctcggtctcggtgtttgtggaccatcacctggcaccctccttctactttgtggccttctactaccmtggagaccacccagtggccaactccctgcgagtggatgtccaggctggggcctgcgagggcaaggtgaccggggtcaggagagatggcacttgtgccgag

SEQ ID NO: 6030 - DNA, 201 bp, Homo sapiens
aaccatgaagctggaagcactgctgtgtccgctttcatgaacacagcctgggaccagggcatattaaaggcttttggcagcaaagtgtcagtgttggcagygaagtgtcagtgtgtgttgctagggctgagagcagtgcccctgcccgatgcagttctgggcaggccaggttgacataaccttagactctctgagccctga

SEQ ID NO: 6031 - DNA, 201 bp, Homo sapiens
ttgtggctttccacaacttattgtcccatatttttatggccagtttatacaggcaccccacaagtccttttcccaacacagacaggaatacggcagcctgygccctgggagctcactgtcttgtgggagggaaccactcaagccactccccacttgtcctcctgtccctctcttcttgggctctgtcccccacctctctct

SEQ ID NO: 6032 - DNA, 201 bp, Homo sapiens
acactgtggctccccgactctctgaccacgtgggagatccatggcctgagcctgtccaaaaccaaaggtgatgtcaccctgtctgggcctcaggtgacccygcttccatttccctgtaccccagctccctgttccctttgctcttagtgtaggaagagggtccagtgatctggggaggtctgtgccagcgtgcagctggcg

SEQ ID NO: 6033 - DNA, 201 bp, Homo sapiens
actgtggctccccgactctctgaccacgtgggagatccatggcctgagcctgtccaaaaccaaaggtgatgtcaccctgtctgggcctcaggtgaccctgmttccatttccctgtaccccagctccctgttccctttgctcttagtgtaggaagagggtccagtgatctggggaggtctgtgccagcgtgcagctggcgtg

SEQ ID NO: 6034 - DNA, 201 bp, Homo sapiens
tgtcaggctccccagcttctggcattcctgtcaaagtttctgccacggtgtcttctcctgggtctgttcctgaagtccaggacattcagcaaaacacagaygggagcggccaagtcagcattccaataattatccctcagaccatctcagagctgcagctctcagtaggactcctcggacccctgggagatggtgggggaa

SEQ ID NO: 6035 - DNA, 201 bp, Homo sapiens
gtattttgtgtcatctcccttctccttggatcttagcaagaccaagcgacaccttgtgcctggggcccccttcctgctgcaggtttcttccagaggggaasgatgagtagggaggatgtggtagttaggagggctcagggtctgaccactctcttttgcctgccctcctttacctgcctaggccttggtccgtgagatgtc

SEQ ID NO: 6036 - DNA, 201 bp, Homo sapiens
gctggcccccagctctctccctttttcctcaggaacccaggggtccaggcccaagaccctcctcccgttttcttccaggaagcctccatctcaaaggcaarctcatttttgggggagaaagcaagtgctgggctcctgggtgcccacgcagctgccatcacggcctatgccctgacactgaccaaggcccctgcggacctg

SEQ ID NO: 6037 - DNA, 201 bp, Homo sapiens
tggcgggggtgggtagtcctcagaccaagggcttgcttgagtcctggctcaacctccctaggacacggtgattgccctggatgccctgtctgcctactggwttgcctcccacaccactgaggagaggggtctcaatgtgactctcagctccacaggccggaatgggttcaagtcccacgcgctgcagctgaacaaccgcca

SEQ ID NO: 6038 - DNA, 201 bp, Homo sapiens
tcatttttgggggagaaagcaagtgctgggctcctgggtgcccacgcagctgccatcacggcctatgccctgacactgaccaaggcccctgcggacctgckgggtgttgcccacaacaacctcatggcaatggcccaggagactggaggtgaggggtgaggcgctctggcagtgagcctgaggcccaggggaccttaggat

SEQ ID NO: 6039 - DNA, 201 bp, Homo sapiens
cctctcatgctcacccccacctggccctgcagtgggtcagtatgcttccccgacagccaagcgctgctgccaggatggggtgacacgtctgcccatgatgmgttcctgcgagcagcgggcagcccgcgtgcagcagccggactgccgggagcccttcctgtcctgctgccaatttgctgagagtctgcgcaagaagagcag

SEQ ID NO: 6040 - DNA, 201 bp, Homo sapiens
catttttgggggagaaagcaagtgctgggctcctgggtgcccacgcagctgccatcacggcctatgccctgacactgaccaaggcccctgcggacctgcgsggtgttgcccacaacaacctcatggcaatggcccaggagactggaggtgaggggtgaggcgctctggcagtgagcctgaggcccaggggaccttaggatc

SEQ ID NO: 6041 - DNA, 201 bp, Homo sapiens
gcggtgtccaaggttctgcagattgaggtgaatggagcacccctgaatataagtccccgggcccccagctttgtcctccaccctcagcactctctctgctrgccaggccaggggcccaacacccgaaccaatgccttggtctgttcccatcttctacaattctgatccaactctgtccctggagttgaaactcaaagttct

SEQ ID NO: 6042 - DNA, 201 bp, Homo sapiens
aaccccttgggtgagtgaccctctacctccagccattggtttcctaagtgggtacaggtggtgggggatgtggacagcaggacaggctgccaacttccccmatttccccagaccaccgaggccggaccttggaaatacctggcaactctgatcccaatatgatccctgatggggactttaacagctacgtcagggttacag

SEQ ID NO: 6043 - DNA, 201 bp, Homo sapiens
gagtgtgggggttgggaggccttggggccaggcaggggctggcgcagggagccgggtggccatcccagccctcctcacaatgcttccctgtgcagtggaascaaacgaggactatgaggactatgagtacgatgagcttccagccaaggatgacccagatgcccctctgcagcccgtgacacccctgcagctgtttgaggg

SEQ ID NO: 6044 - DNA, 201 bp, Homo sapiens
tggtgtttggtctgttttcagaagtgtcttttgcatctgtagactaaaagtaaacagcataaacagatacacattaaagtaaaatttgtaatagttgatcmtttaatggtcttaatctgtttaagaggatttatgtttgaaagtccgtcagtagctccaatgagaatgtcagtctcaggcaggagggttaaatgagcctga

SEQ ID NO: 6045 - DNA, 201 bp, Homo sapiens
gtgtttgtggaccatcacctggcaccctccttctactttgtggccttctactaccatggagaccacccagtggccaactccctgcgagtggatgtccaggmtggggcctgcgagggcaaggtgaccggggtcaggagagatggcacttgtgccgagggggttgaggacagggtgattgccaacagggcatggatttagctt

SEQ ID NO: 6046 - DNA, 201 bp, Homo sapiens
cccctgcttgctttcgcttgctctccccatctctgggtacctgttgtttcctttacccgcctcagtgctggtggctccgaatcccactcctcagcccaggsctcttccctgaaccatgggccccactcgtcccactcccacagcacctcagacgaggcatgtcccaaagcccttcttcattctgtgtctcttgtctggctg

SEQ ID NO: 6047 - DNA, 201 bp, Homo sapiens
caggggctggcgcagggagccgggtggccatcccagccctcctcacaatgcttccctgtgcagtggaagcaaacgaggactatgaggactatgagtacgaygagcttccagccaaggatgacccagatgcccctctgcagcccgtgacacccctgcagctgtttgagggtcggaggaaccgccgcaggagggaggcgccca

SEQ ID NO: 6048 - DNA, 201 bp, Homo sapiens
cttggtgctgcatcctagattctgtgctgagacggccttctccctacctggaacttctctctacctcctgtctcccctgtctgatccactgtccacacggsagtgacactgaccttccaaaagccccagccagatcagccttggggaaaagtcactccccgctgcccacggctcagatggctgggcctctgcccacccctc

SEQ ID NO: 6049 - DNA, 201 bp, Homo sapiens
ttctccctgccttcctgtttactcgtggtctcccttcactttcagataacctgtactggggctcagtcactggttctcagagcaatgccgtgtcgcccacsccggctcctcgcaacccatccgaccccatgccccaggccccagccctgtggattgaaaccacagcctacgccctgctgcacctcctgcttcacgagggca

SEQ ID NO: 6050 - DNA, 201 bp, Homo sapiens
atttccctgtaccccagctccctgttccctttgctcttagtgtaggaagagggtccagtgatctggggaggtctgtgccagcgtgcagctggcgtgggccrgagggcagaggcggactgagacagagctgggtcacccccacccctccctcctgtggccctgaagctttgatggcccctctgatctctgcccctgtgccca

SEQ ID NO: 6051 - DNA, 201 bp, Homo sapiens
ccagctccctgttccctttgctcttagtgtaggaagagggtccagtgatctggggaggtctgtgccagcgtgcagctggcgtgggccagagggcagaggcrgactgagacagagctgggtcacccccacccctccctcctgtggccctgaagctttgatggcccctctgatctctgcccctgtgcccacgcttcctttccc

SEQ ID NO: 6052 - DNA, 201 bp, Homo sapiens
agagggcagaggcggactgagacagagctgggtcacccccacccctccctcctgtggccctgaagctttgatggcccctctgatctctgcccctgtgcccrcgcttcctttccctcaggcctatgtgtggccaccccagtccagctccgggtgttccgcgagttccacctgcacctccgcctgcccatgtctgtccgccgc

SEQ ID NO: 6053 - DNA, 201 bp, Homo sapiens
gatgctgggtgcttggattggggcagggctggcatcgggacccgattcaggagtgagggagagcaggggtggaggtgtcagagcgaagtctgactgctgawcctgtctgttctccccaggttgctcttgttctctccttctgtggttcatctgggggtccccctatcggtgggggtgcagctccaggatgtgccccgagga

SEQ ID NO: 6054 - DNA, 201 bp, Homo sapiens
tgaagtccaggacattcagcaaaacacagacgggagcggccaagtcagcattccaataattatccctcagaccatctcagagctgcagctctcagtaggaytcctcggacccctgggagatggtgggggaaggggaggagggtgagctggggtcccaaggatccatggcctgacttggggggaaggtggggtacttggctc

SEQ ID NO: 6055 - DNA, 201 bp, Homo sapiens
acctctctgtctcgcctgacgcctgtggcgaatgtggtgccactcgtgtgtgtggactgtgcagtgacggggaggaaaaggggctgaaggcctcaaatccygtagcccagggagatgcccttaggtatggcaccagagaggtctgtggcctcacatgtcccacgtcctctccctgccccttgctgagccaggtccttcgta

SEQ ID NO: 6056 - DNA, 201 bp, Homo sapiens
cgtgggcacgaggaggggtcaggcctgggacctgagtcggggggtcaggcaggatgacagaacctgcagttaggttgtggcaaataaaggaggacccagtkgtatccatgacaaagatgaggccgcgaggagggcgagtgggtttgggggcaggcagagtgccttggagaacttacaggtcctgccacaatcctaatgcaa

SEQ ID NO: 6057 - DNA, 201 bp, Homo sapiens
tagtcccttcccagtggccaccttcggattcatgtgggacctgtggatccctgcttggtcccactccccgtgagcctctgacacagagtcctcagacctcyaccctctccctcccatgtagcctcagatccattggacactttaggctctgagggggccttgtcaccaggaggcgtggcctccctcttgaggcttcctcga

SEQ ID NO: 6058 - DNA, 201 bp, Homo sapiens
tgcttccgtcctgggtgtttttccccctgcttgctttcgcttgctctccccatctctgggtacctgttgtttcctttacccgcctcagtgctggtggctcygaatcccactcctcagcccaggcctcttccctgaaccatgggccccactcgtcccactcccacagcacctcagacgaggcatgtcccaaagcccttcttc

SEQ ID NO: 6059 - DNA, 201 bp, Homo sapiens
cactattttttgagtacagtcactcagatctaagaagcagatgttcagggagaaacagtgaaagggaggcagtgggtcataggcgtaatctatagcaatasagttttaaatgaatctcctttgtgctcaaacagcatgtctttaaattatcggagagtagctggtggaagtgggcttagctagaagactgcatgtctgtcc

SEQ ID NO: 6060 - DNA, 201 bp, Homo sapiens
cgtaatctatagcaatagagttttaaatgaatctcctttgtgctcaaacagcatgtctttaaattatcggagagtagctggtggaagtgggcttagctagragactgcatgtctgtccaatgcttcaaaggagggtctttctccttgaacacagtgtttacagataagacagggggtctcactctgagcatgggaacatga

SEQ ID NO: 6061 - DNA, 201 bp, Homo sapiens
gccgggagctgccctgggccaggggagggagggcaggacccaggctggggctgggcttctggagcccgcgcaggcagaacctggacgacagctcacacgtytccacaggcggaacggcaaggtggggctgtctggcatggccatcgcggacgtcaccctcctgagtggattccacgccctgcgtgctgacctggagaaggt

SEQ ID NO: 6062 - DNA, 201 bp, Homo sapiens
ataggaagcaaacaaaaacaggccaaggaaacccagtacagggggctgcagggcccagggagtgggtccctcatctctcctccccacgcttggccaggtcyccacctcccgggagtgcgtgggctttgaggctgtgcaggaagtgccggtggggctggtgcagccggccagcgcaaccctgtacgactactacaaccccgg

SEQ ID NO: 6063 - DNA, 201 bp, Homo sapiens
aatatgatccctgatggggactttaacagctacgtcagggttacaggtgggagtgccctttagtcccttcccagtggccaccttcggattcatgtgggacytgtggatccctgcttggtcccactccccgtgagcctctgacacagagtcctcagacctccaccctctccctcccatgtagcctcagatccattggacact

SEQ ID NO: 6064 - DNA, 201 bp, Homo sapiens
cagtgtttacagataagacagggggtctcactctgagcatgggaacatgatggcaattaggaggcttttcttctcagaggcctcttgtggctttccacaayttattgtctcatatttttatggacagtttatacaggcaccccacaagtccttttcccaacatgcccccctccctttttttttttttaaccgctattgcta

SEQ ID NO: 6065 - DNA, 201 bp, Homo sapiens
gtgtagcctgctcctcttacaggtcatgcacgcagcctgtttgctctgacaccaacttcctaccctctcagcctcaaagtaactcacctttcccccttctyctcaccccctcttaggcttccaggttaaggttctccgagaagacagcagagctgctttccgcctctttgagaccaagatcacccaagtcctgcacttcag

SEQ ID NO: 6066 - DNA, 201 bp, Homo sapiens
gaggcggactgagacagagctgggtcacccccacccctccctcctgtggccctgaagctttgatggcccctctgatctctgcccctgtgcccacgcttccyttccctcaggcctatgtgtggccaccccagtccagctccgggtgttccgcgagttccacctgcacctccgcctgcccatgtctgtccgccgctttgagca

SEQ ID NO: 6067 - DNA, 201 bp, Homo sapiens
cattggtttcctaagtgggtacaggtggtgggggatgtggacagcaggacaggctgccaacttcccccatttccccagaccaccgaggccggaccttggamatacctggcaactctgatcccaatatgatccctgatggggactttaacagctacgtcagggttacaggtgggagtgccctttagtcccttcccagtggcc

SEQ ID NO: 6068 - DNA, 201 bp, Homo sapiens
ggtctcactctgagcatgggaacatgatggcaattaggaggcttttcttctcagaggcctcttgtggctttccacaacttattgtctcatatttttatggmcagtttatacaggcaccccacaagtccttttcccaacatgcccccctccctttttttttttttaaccgctattgctattatggcttatttgtggtgtttg

SEQ ID NO: 6069 - DNA, 201 bp, Homo sapiens
tgggaaagaatatttgatcatgggtctggatggggccacctatgacctcgagggacagtgagtcatctggtcccctcagtctcttgtcctccccatgcctygccacctaggccttgcccctcagaagccagatgcctgtgctctccgtttccacctgccatcctcccgagccctgctgactgcccctttgccccctgcagc

SEQ ID NO: 6070 - DNA, 201 bp, Homo sapiens
tgtgggacctgtggatccctgcttggtcccactccccgtgagcctctgacacagagtcctcagacctccaccctctccctcccatgtagcctcagatccaytggacactttaggctctgagggggccttgtcaccaggaggcgtggcctccctcttgaggcttcctcgaggctgtggggagcaaaccatgatctacttggc

SEQ ID NO: 6071 - DNA, 201 bp, Homo sapiens
tctttttaactttagtaaatacgtttacacacggaattttttacaattatcattttaaaacttgtttagatctttaaaacaaaattaaacaaccttttttrtataaattttttataactttttttatgacttttacagacaatttttaacatgtcttaactttttatgttttataatttttttactaaaggtacattttta

SEQ ID NO: 6072 - DNA, 201 bp, Homo sapiens
ctccatgggggtggcgaaggtggaatgagaggatctacacagagtccccagcctgggctcaccctgcaccttctcttcccctctgaccacttttgcgcacrtcatccccgcagccaaggatgtcaaggccgctgctaatcagatgcgcaacttcctggttcgagcctcctgccgccttcgcttggaacctgggaaagaata

SEQ ID NO: 6073 - DNA, 201 bp, Homo sapiens
gttgtttcctttacccgcctcagtgctggtggctccgaatcccactcctcagcccaggcctcttccctgaaccatgggccccactcgtcccactcccacarcacctcagacgaggcatgtcccaaagcccttcttcattctgtgtctcttgtctggctggtgggagcccctcccagccaggagcccagccactactctaga

SEQ ID NO: 6074 - DNA, 201 bp, Homo sapiens
gcccccagtacctgctggactcgaatagctggatcgaggagatgccctctgaacgcctgtgccggagcacccgccagcgggcagcctgtgcccagctcaaygacttcctccaggagtatggcactcaggggtgccaggtgtgagggctgccctcccacctccgctgggaggaacctgaacctgggaaccatgaagctggaa

SEQ ID NO: 6075 - DNA, 201 bp, Homo sapiens; identical to SEQ ID NO: 3247

SEQ ID NO: 6076 - DNA, 201 bp, Homo sapiens
tcagtctcttgtcctccccatgcctcgccacctaggccttgcccctcagaagccagatgcctgtgctctccgtttccacctgccatcctcccgagccctgytgactgcccctttgccccctgcagcccccagtacctgctggactcgaatagctggatcgaggagatgccctctgaacgcctgtgccggagcacccgccag

SEQ ID NO: 6077 - DNA, 201 bp, Homo sapiens
cttgtcctccccatgcctcgccacctaggccttgcccctcagaagccagatgcctgtgctctccgtttccacctgccatcctcccgagccctgctgactgyccctttgccccctgcagcccccagtacctgctggactcgaatagctggatcgaggagatgccctctgaacgcctgtgccggagcacccgccagcgggcag

SEQ ID NO: 6078 - DNA, 201 bp, Homo sapiens
ggagcaggtaggaggctcgcctgagaaactgcaggagacatctaactggcttctgtcccagcagcaggctgacggctcgttccaggacctctctccagtgwtacataggagcatgcaggtgcgggcatgctggggctggcccgagaagcgcctgtcggaggactctctttgccccttccccctcctgtttgacatcttttc

SEQ ID NO: 6079 - DNA, 201 bp, Homo sapiens
agagacaggttaagagttcataaagagtgggggccagggggccaattgcaaaatggaggctgcaaaaggctcagagctctggtctccacactattttttgmgtacagtcactcagatctaagaagcagatgttcagggagaaacagtgaaagggaggcagtgggtcataggcgtaatctatagcaatagagttttaaatga

SEQ ID NO: 6080 - DNA, 201 bp, Homo sapiens
gtggactgtgcagtgacggggaggaaaaggggctgaaggcctcaaatcccgtagcccagggagatgcccttaggtatggcaccagagaggtctgtggcctyacatgtcccacgtcctctccctgccccttgctgagccaggtccttcgtacctacaatgtcctggacatgaagaacacgacctgccaggacctacagatag

SEQ ID NO: 6081 - DNA, 201 bp, Homo sapiens
ttggcccaggagcaggtaggaggctcgcctgagaaactgcaggagacatctaactggcttctgtcccagcagcaggctgacggctcgttccaggacctctstccagtgatacataggagcatgcaggtgcgggcatgctggggctggcccgagaagcgcctgtcggaggactctctttgccccttccccctcctgtttgac

SEQ ID NO: 6082 - DNA, 201 bp, Homo sapiens
atctgtagactaaaagtaaacagcataaacagatacacattaaagtaaaatttgtaatagttgatcctttaatggtcttaatctgtttaagaggatttatrtttgaaagtccgtcagtagctccaatgagaatgtcagtctcaggcaggagggttaaatgagcctgagatgctttaaaaacctgtttttttaaaatttggt

SEQ ID NO: 6083 - DNA, 201 bp, Homo sapiens
ggagatccatggcctgagcctgtccaaaaccaaaggtgatgtcaccctgtctgggcctcaggtgaccctgcttccatttccctgtaccccagctccctgtyccctttgctcttagtgtaggaagagggtccagtgatctggggaggtctgtgccagcgtgcagctggcgtgggccagagggcagaggcggactgagacaga

SEQ ID NO: 6084 - DNA, 201 bp, Homo sapiens
atttttaaagagcaggttagtgttttaagaaaaacttgtgttttattttaatgtttagtttatagaaaactggatgatatctttttaactttagtaaataygtttacacacggaattttttacaattatcattttaaaacttgtttagatctttaaaacaaaattaaacaaccttttttgtataaattttttataactttt

SEQ ID NO: 6085 - DNA, 201 bp, Homo sapiens
gtgagtgtcacctgagcggccacctctcctctccaaggctacatgcggatccagcagtttcggaaggcggatggttcctatgcggcttggttgtcacgggrcagcagcacctggtgagcttgggagagtggttccagggttctgagggggtcagggctggggcaggggtgggacagagctggtatgatgggagggtggata

SEQ ID NO: 6086 - DNA, 201 bp, Homo sapiens
ggtgcttggattggggcagggctggcatcgggacccgattcaggagtgagggagagcaggggtggaggtgtcagagcgaagtctgactgctgatcctgtcygttctccccaggttgctcttgttctctccttctgtggttcatctgggggtccccctatcggtgggggtgcagctccaggatgtgccccgaggacaggtag

SEQ ID NO: 6087 - DNA, 201 bp, Homo sapiens
gtgcttggattggggcagggctggcatcgggacccgattcaggagtgagggagagcaggggtggaggtgtcagagcgaagtctgactgctgatcctgtctkttctccccaggttgctcttgttctctccttctgtggttcatctgggggtccccctatcggtgggggtgcagctccaggatgtgccccgaggacaggtagt

SEQ ID NO: 6088 - DNA, 201 bp, Homo sapiens
cctcgtgttggggacactctgaacctgaacttgcgagccgtgggcagtggggccaccttttctcattactactacatggtgtgcatgagctggggagtcamggagggctggggtgcagggaagagccctctgggtggggctgggggggttcaaggctgaggctgtcccatgaagaggcaaccactcttgtccctcccattc

SEQ ID NO: 6089 - DNA, 201 bp, Homo sapiens
tttatttattggaactataatttttattgggctcagtgccacaaagtttaataattcatatatgagcctgtccaattagaattgccatctgatttaagtayactgtaagtgcttttatggtattatgtggcaaaaaggaccatttaactaaatcatcattttgaacaataacccccattattgtgtggttagtgtgaagta

SEQ ID NO: 6090 - DNA, 201 bp, Homo sapiens
aggatgtcaaggccgctgctaatcagatgcgcaacttcctggttcgagcctcctgccgccttcgcttggaacctgggaaagaatatttgatcatgggtctrgatggggccacctatgacctcgagggacagtgagtcatctggtcccctcagtctcttgtcctccccatgcctcgccacctaggccttgcccctcagaagc

SEQ ID NO: 6091 - DNA, 201 bp, Homo sapiens
ggcaaaacagtgaaagggtagcagtgcgtcacaggcataatctacagcagaagcgctttaaatgaatctcctttgtgctcaaacagcatatctttaacttrtcggagagtagctagtgggagtgggcttaactaggagcctgcacgtctgtccacattccaatgcttcaaaggagggtctttctccttgaatacagtgttt

SEQ ID NO: 6092 - DNA, 201 bp, Homo sapiens
ctgtgccggagcacccgccagcgggcagcctgtgcccagctcaacgacttcctccaggagtatggcactcaggggtgccaggtgtgagggctgccctcccmcctccgctgggaggaacctgaacctgggaaccatgaagctggaagcactgctgtgtccgctttcatgaacacagcctgggaccagggcatattaaaggct

SEQ ID NO: 6093 - DNA, 201 bp, Homo sapiens
gggcccccttcctgctgcaggtttcttccagaggggaaggatgagtagggaggatgtggtagttaggagggctcagggtctgaccactctcttttgcctgmcctcctttacctgcctaggccttggtccgtgagatgtcaggctccccagcttctggcattcctgtcaaagtttctgccacggtgtcttctcctgggtctg

SEQ ID NO: 6094 - DNA, 201 bp, Homo sapiens
ctgcaggtttcttccagaggggaaggatgagtagggaggatgtggtagttaggagggctcagggtctgaccactctcttttgcctgccctcctttacctgmctaggccttggtccgtgagatgtcaggctccccagcttctggcattcctgtcaaagtttctgccacggtgtcttctcctgggtctgttcctgaagtccag

SEQ ID NO: 6095 - DNA, 201 bp, Homo sapiens
cctctccaggtatctgcaggctccccacatccagcgatagccaggctcactgtggcagccccaccttcaggaggccccgggtttctgtctattgagcggcyggattctcgacctcctcgtgttggggacactctgaacctgaacttgcgagccgtgggcagtggggccaccttttctcattactactacatggtgtgcatg

SEQ ID NO: 6096 - DNA, 201 bp, Homo sapiens
cagtatgcttccccgacagccaagcgctgctgccaggatggggtgacacgtctgcccatgatgcgttcctgcgagcagcgggcagcccgcgtgcagcagcyggactgccgggagcccttcctgtcctgctgccaatttgctgagagtctgcgcaagaagagcagggacaagggccaggcgggcctccaacgaggtgagggg

SEQ ID NO: 6097 - DNA, 201 bp, Homo sapiens
gggcctcaggtgaccctgcttccatttccctgtaccccagctccctgttccctttgctcttagtgtaggaagagggtccagtgatctggggaggtctgtgycagcgtgcagctggcgtgggccagagggcagaggcggactgagacagagctgggtcacccccacccctccctcctgtggccctgaagctttgatggcccc

SEQ ID NO: 6098 - DNA, 201 bp, Homo sapiens
gaccctgcttccatttccctgtaccccagctccctgttccctttgctcttagtgtaggaagagggtccagtgatctggggaggtctgtgccagcgtgcagmtggcgtgggccagagggcagaggcggactgagacagagctgggtcacccccacccctccctcctgtggccctgaagctttgatggcccctctgatctctg

SEQ ID NO: 6099 - DNA, 201 bp, Homo sapiens
aggatggctacaggatgaagtttgcctgctactacccccgtgtggagtacggtcagtcttcccaccgaggccctggcctgaccctccctcggggaccggcygttttggtctctctgggtgtagcctgctcctcttacaggtcatgcacgcagcctgtttgctctgacaccaacttcctaccctctcagcctcaaagtaact

SEQ ID NO: 6100 - DNA, 201 bp, Homo sapiens
aaggcaagctcatttttgggggagaaagcaagtgctgggctcctgggtgcccacgcagctgccatcacggcctatgccctgacactgaccaaggcccctgyggacctgcggggtgttgcccacaacaacctcatggcaatggcccaggagactggaggtgaggggtgaggcgctctggcagtgagcctgaggcccagggga

SEQ ID NO: 6101 - DNA, 201 bp, Homo sapiens
ggctaaccgggccaggactctggccatcctcgttttcctgccctcaggtgagcgtccacgtgtccccagtggaggggctgtgcctggctgggggcggaggkctggcccagcaggtgctggtgcctgcgggctctgcccggcctgttgccttctctgtggtgcccacggcagccgccgctgtgtctctgaaggtggtggctc

SEQ ID NO: 6102 - DNA, 201 bp, Homo sapiens
actatttattgagtacaataacttagatctaagaagcagatgttcagggcaaaacagtgaaagggtagcagtgcgtcacaggcataatctacagcagaagygctttaaatgaatctcctttgtgctcaaacagcatatctttaacttatcggagagtagctagtgggagtgggcttaactaggagcctgcacgtctgtcca

SEQ ID NO: 6103 - DNA, 201 bp, Homo sapiens
attttttgaaatctgcctctgctaaaggaattgtaaaaaagcagtcttttaaatctataataacaagcggtcagtctttagggagcacagtgggggatggragcccaggttgtaaggctcccatcggttgaattacagcgttgacgccatctaccggactttttcttaattacaaatactggggaattccaaggagagaaa

SEQ ID NO: 6104 - DNA, 201 bp, Homo sapiens
tgaactgtgggtcgggcaataatgggcacggtgagccaagtctcgggctccctccccctgcacccactcggctgaggaggaggtggccattctggacattyctctacaggaaccgtgggctgaacaattttttgagtaggtttagggagactggggagattggcataaatcatcttcagactctcctttttgttagtactc

SEQ ID NO: 6105 - DNA, 201 bp, Homo sapiens
tgcttggattggggcagggctggcatcgggacccgattcaggagtgagggagagcaggggtggaggtgtcagagcgaagtctgactgctgatcctgtctgytctccccaggttgctcttgttctctccttctgtggttcatctgggggtccccctatcggtgggggtgcagctccaggatgtgccccgaggacaggtagtg

SEQ ID NO: 6106 - DNA, 201 bp, Homo sapiens
aggcaccccacaagtccttttcccaacacagacaggaatacggcagcctgtgccctgggagctcactgtcttgtgggagggaaccactcaagccactcccyacttgtcctcctgtccctctcttcttgggctctgtcccccacctctctctgtcctttgtcttgcaggtggggagatggaggaggcagagctcacatcctg

SEQ ID NO: 6107 - DNA, 201 bp, Homo sapiens
ggcccaacacccgaaccaatgccttggtctgttcccatcttctacaattctgatccaactctgtccctggagttgaaactcaaagttctgggggagtctgygctagcagggcaggctgtagtcctgtgtgacctcacaaccatgttttccctgagacagaaggaaggggccatccatagagaggagctggtctatgaactc

SEQ ID NO: 6108 - DNA, 201 bp, Homo sapiens
tagaaggctgaagtgagataattcatgtgctggtataaactttgtggaaatgtgaggtggggagaggaggtggggctgttttgaggaaggagataagttaytggagccgcaaaaacaggtttgcttgtgcccttctaacatcgccttcccttttctgttgctgaagttttccttgggcagcaagatcaatgtgaaggtggg

SEQ ID NO: 6109 - DNA, 201 bp, Homo sapiens
agaaatgaccaggtcagaaccaagggtggtccagaagctaacccttagcttagggacagtttcacagagaacacgtccatgatgcaagactctgctgaggscctggagcagtgaagactggggcaaggtcaccctctgggaagtgaagtcaccagagaccttgcggagcagctttgagagttctctgagtaggaaggtaac

SEQ ID NO: 6110 - DNA, 201 bp, Homo sapiens
tacgttgctgcagccatcattgagtctccaggtgggtgactttcccttattgtaaccccagacccttgcctctgacctctgagctaaccctctgtcctccrgcaccaacaccaccccacttctcacatctcatctcagactcaaaaccaggaaacacccaggagacctggtttctctccaactctgtctctgtgactcggc

SEQ ID NO: 6111 - DNA, 201 bp, Homo sapiens
gaggtgaatggagcacccctgaatataagtccccgggcccccagctttgtcctccaccctcagcactctctctgctggccaggccaggggcccaacacccraaccaatgccttggtctgttcccatcttctacaattctgatccaactctgtccctggagttgaaactcaaagttctgggggagtctgtgctagcagggca

SEQ ID NO: 6112 - DNA, 201 bp, Homo sapiens
tggctcgagggtccttcgaattccctgtgggagatgcggtgtccaaggttctgcagattgaggtgaatggagcacccctgaatataagtccccgggccccyagctttgtcctccaccctcagcactctctctgctggccaggccaggggcccaacacccgaaccaatgccttggtctgttcccatcttctacaattctgat

SEQ ID NO: 6113 - DNA, 201 bp, Homo sapiens
gacaagacagagcagtggagcacactgcctcccgagaccaaggaccacgccgtggatctgatccagaaaggttctgggtgcaagggcaagcaggagggggkccaggaaaggacagttactggaagatggacagcccaggaggctacagagggaaagaaagggggcccctgatgaggatggggagcatggccttgggctcaa

SEQ ID NO: 6114 - DNA, 201 bp, Homo sapiens
ggggctgtgcctggctgggggcggagggctggcccagcaggtgctggtgcctgcgggctctgcccggcctgttgccttctctgtggtgcccacggcagccrccgctgtgtctctgaaggtggtggctcgagggtccttcgaattccctgtgggagatgcggtgtccaaggttctgcagattgaggtgaatggagcacccct

SEQ ID NO: 6115 - DNA, 201 bp, Homo sapiens
acccctccctcctgtggccctgaagctttgatggcccctctgatctctgcccctgtgcccacgcttcctttccctcaggcctatgtgtggccaccccagtycagctccgggtgttccgcgagttccacctgcacctccgcctgcccatgtctgtccgccgctttgagcagctggagctgcggcctgtcctctataactacc

SEQ ID NO: 6116 - DNA, 201 bp, Homo sapiens; identical to SEQ ID NO: 3238

SEQ ID NO: 6117 - DNA, 201 bp, Homo sapiens
tttggggccagagatccgaattccgggattacgagtggaaggtgggcagctctctccagcagcctctcttatgttgctggtctcaaggggtcggggcgggkgctgaggtgtatgtcctttttgtcctctcatgctcacccccacctggccctgcagtgggtcagtatgcttccccgacagccaagcgctgctgccaggatg

SEQ ID NO: 6118 - DNA, 201 bp, Homo sapiens
gcacctccgcctgcccatgtctgtccgccgctttgagcagctggagctgcggcctgtcctctataactacctggataaaaacctgactgtgaggccccatrggagcctgagcatacaggagttgggggagccagggcccagtgaggggtggggaggctaaccgggccaggactctggccatcctcgttttcctgccctcag

SEQ ID NO: 6119 - DNA, 201 bp, Homo sapiens; identical to SEQ ID NO: 3240

SEQ ID NO: 6120 - DNA, 201 bp, Homo sapiens
ccaaaaggcgattaatgagaaatgtgagttgcgggtgcctaggcagtagcttgggctctccacctgggatccgggttgggggtctgcctctctgcccctcrgctccttgctgaacccacgtgtggtatttggggccagagatccgaattccgggattacgagtggaaggtgggcagctctctccagcagcctctcttatgt

SEQ ID NO: 6121 - DNA, 201 bp, Homo sapiens
aggacattcagcaaaacacagacgggagcggccaagtcagcattccaataattatccctcagaccatctcagagctgcagctctcagtaggactcctcggmcccctgggagatggtgggggaaggggaggagggtgagctggggtcccaaggatccatggcctgacttggggggaaggtggggtacttggctctgagctac

SEQ ID NO: 6122 - DNA, 201 bp, Homo sapiens
gagaaacgtgaacttccaaaaggcgattaatgagaaatgtgagttgcgggtgcctaggcagtagcttgggctctccacctgggatccgggttgggggtctkcctctctgcccctcggctccttgctgaacccacgtgtggtatttggggccagagatccgaattccgggattacgagtggaaggtgggcagctctctccag

SEQ ID NO: 6123 - DNA, 201 bp, Homo sapiens
cgtgcagctggcgtgggccagagggcagaggcggactgagacagagctgggtcacccccacccctccctcctgtggccctgaagctttgatggcccctctratctctgcccctgtgcccacgcttcctttccctcaggcctatgtgtggccaccccagtccagctccgggtgttccgcgagttccacctgcacctccgcct

SEQ ID NO: 6124 - DNA, 201 bp, Homo sapiens
cggagcacccgccagcgggcagcctgtgcccagctcaacgacttcctccaggagtatggcactcaggggtgccaggtgtgagggctgccctcccacctccrctgggaggaacctgaacctgggaaccatgaagctggaagcactgctgtgtccgctttcatgaacacagcctgggaccagggcatattaaaggcttttggc

SEQ ID NO: 6125 - DNA, 201 bp, Homo sapiens
tagttctgcctacaaaagtttgacaaactgtgggactatttaacataccctggggcaaaactttccaatgatatttggctgcaggttttttgttattaacrgcaggaatggtaaaggcaaattttttgaaatctgcctctgctaaaggaattgtaaaaaagcagtcttttaaatctataataacaagcggtcagtctttag

SEQ ID NO: 6126 - DNA, 201 bp, Homo sapiens
cagcatttgtaattgtcttttgcaaagattaataatattgaataagttggtctctactttttgctgcacaaatctggaaactgatctctaacaggctggakagttctgcctacaaaagtttgacaaactgtgggactatttaacataccctggggcaaaactttccaatgatatttggctgcaggttttttgttattaacg

SEQ ID NO: 6127 - DNA, 201 bp, Homo sapiens
ttgttaaattaatctgtcatgtaactgagttaataaatgcctgtttaacctgatttttatttattggaactataatttttattgggctcagtgccacaaartttaataattcatatatgagcctgtccaattagaattgccatctgatttaagtatactgtaagtgcttttatggtattatgtggcaaaaaggaccattta

SEQ ID NO: 6128 - DNA, 201 bp, Homo sapiens
gggggagccagggcccagtgaggggtggggaggctaaccgggccaggactctggccatcctcgttttcctgccctcaggtgagcgtccacgtgtccccagyggaggggctgtgcctggctgggggcggagggctggcccagcaggtgctggtgcctgcgggctctgcccggcctgttgccttctctgtggtgcccacggca

SEQ ID NO: 6129 - DNA, 201 bp, Homo sapiens
tttttacttttttgtatttttttgatttttgtcttagtcttttttttacttttatttttttaaatgtgtaataattagatgagtgttggtaacaatggatrtatgtacatattttagtttttaaaatttagggatgtgtttaacatctgtttgccagaactgactaggttccaattctttacggttaacacctattgaagg

SEQ ID NO: 6130 - DNA, 201 bp, Homo sapiens
agcagagatggcagaccaggctgcggcctggctcacccgtcagggcagcttccaagggggattccgcagtacccaagtaggggccgtccccgggctctggsgggggtgggtagtcctcagaccaagggcttgcttgagtcctggctcaacctccctaggacacggtgattgccctggatgccctgtctgcctactggattg

SEQ ID NO: 6131 - DNA, 201 bp, Homo sapiens
tgaggcttcctcgaggctgtggggagcaaaccatgatctacttggctccgacactggctgcttcccgctacctggacaagacagagcagtggagcacactkcctcccgagaccaaggaccacgccgtggatctgatccagaaaggttctgggtgcaagggcaagcaggaggggggccaggaaaggacagttactggaagat

SEQ ID NO: 6132 - DNA, 201 bp, Homo sapiens
tctctcaaactcaggtggcagaggttgccgtgagccgagatcgcaccactgcactccagcccgggcaacagagcgagactctgtctcaaaaaaaaaaaaaagaagaagataacacatgtagggttttggcttcatgtgtagcagatatttggtcaatggttgcttattttttggcgtcaccatagggagaaatatggttaa

SEQ ID NO: 6133 - DNA, 201 bp, Homo sapiens
ccaaggtgggtggatcgcttgaggtcaggagttcgagaccagcctggccaatatggcaaaaccctgtctctactaaaaatacaaaaaaaattagccgggtrtggtggctcatgcctgtagtcccagctactcgggagactgaggcaggagaatcgcttgaacccgggaggcagaggttgcagtgagccgagatcgcaccac

SEQ ID NO: 6134 - DNA, 201 bp, Homo sapiens
agtgtcaggagggctctggggtcagcctgggtgttaatcccagctctgctgcttgctggccccatgaccttggtatggttacttcacttctctgagcctcrcttttcctgtttgtgaaatggggacaatggcagcatccaccgcatagggttgttacgaaggtcaaggtcgtcacgtgcacgcctggcaccatgcctgtgc

SEQ ID NO: 6135 - DNA, 201 bp, Homo sapiens
aggaagcggaggttgcagtgagctgagatcacgccattgtactgcagcctaggcgacagagcaagactctgtctcaaaaaaaaaaaaaagtatatatatawgctgggtgctgtggctcatgcctgtaatcccagcactttgggaggccaaggtgggtggatcgcttgaggtcaggagttcgagaccagcctggccaatatg

SEQ ID NO: 6136 - DNA, 201 bp, Homo sapiens
gccgggctgccctggctgggggcaggagcacgcctgggcatggggatcctgtccccgtctccttcccctccccctccctccattctcagtcacaggcctcrgggagctgctcagggaggcccaggaggggaggaacagggcttcgtgtgggaggatttctgcaggcagctgggactttcctccccagcttggctggaggcc

SEQ ID NO: 6137 - DNA, 201 bp, Homo sapiens
ttgcttgaacccaggaagcggaggttgcagtgagctgagatcacgccattgtactgcagcctaggcgacagagcaagactctgtctcaaaaaaaaaaaaaagtatatatatatgctgggtgctgtggctcatgcctgtaatcccagcactttgggaggccaaggtgggtggatcgcttgaggtcaggagttcgagaccagc

SEQ ID NO: 6138 - DNA, 201 bp, Homo sapiens
cggccctccactggcgactcagggctgctggcccttccgtggcaggacccactcggcagcagttcacagtgagcagtggcgagagcccaccgctgagcgcyggcaacatctaccagaagaggccggtcctgggcgacatcgtgtcagggcctgtgctcagctgcctcctccacatcgcccgcctgtatggggagcctgtcc

SEQ ID NO: 6139 - DNA, 201 bp, Homo sapiens
tgggaggctgtttactgcctgtagaccgctgagcagagtccatggccctgccgggctgccctggctgggggcaggagcacgcctgggcatggggatcctgyccccgtctccttcccctccccctccctccattctcagtcacaggcctcggggagctgctcagggaggcccaggaggggaggaacagggcttcgtgtggga

SEQ ID NO: 6140 - DNA, 201 bp, Homo sapiens
tgaaccctgggcttgtccgtgccctggccatcagccccagtggccgtagtgtcgtggccggcttctcctcaggcttcatggtgctcctggacacccgcacrggcctggttctgcgaggctggccagcccacgagggggacattctgcagatcaaggtgacgggccgggtctccctccccttgctgcccaacccccgcccct

SEQ ID NO: 6141 - DNA, 201 bp, Homo sapiens
cgctgtacaactacggcgacgggaccagcgagacggccccacgcctcgtctacacccagcaccgcaagagcgtcttcttcgtgggccagcttgaggccccrcagcacgtggtgagctgtgacggggctgtgcacgtctgggaccccttcacaggtgagcgggcccaggtgaggcctgttctcttcctgctcctgcgcccca

SEQ ID NO: 6142 - DNA, 201 bp, Homo sapiens
ctcctgctgggctcagacaacggggttatccgcctcctggcatagactgaggcaggagctggccgggcaagggtgggaagacatctgcgggcgcgtgtccrctcaccctgttccctgagcagcagctccctccagggaggccctgggtcccacgccctgggtgcccacatggcctgccaactagggcctgcaaatggagtg

SEQ ID NO: 6143 - DNA, 201 bp, Homo sapiens
agatcggcgtgagccagcaggatgcccactttcacttccaccagatccgcctgcagagcttcccgggccactcgggggccgtcaagtgcgtggcacccctragcagcgaggacttcttcctgagcggcagcaaggatcgtaccgtgcgcctctggccgctgtacaactacggcgacgggaccagcgagacggccccacgcc

SEQ ID NO: 6144 - DNA, 201 bp, Homo sapiens; identical to SEQ ID NO: 4847

SEQ ID NO: 6145 - DNA, 201 bp, Homo sapiens
cacgagctggttggggagctggcggcgctgtacttggagagcatcagccccagcagtcgcaaccctgccagcgtggagcccaccatgcccggcaccgggcmcgagtgggacccccatggtgggggctgccctcaggatgacggccactcagggacctttgggagcgtcctggtggggaaccgcattcagatccccaatgac

SEQ ID NO: 6146 - DNA, 201 bp, Homo sapiens
gctgccctcaggatgacggccactcagggacctttgggagcgtcctggtggggaaccgcattcagatccccaatgactctcggcctgagaaccccggaccrctgggccccatctcgggggtgggtggcgggggcctgggcagcgggagcgacgacaacgccctgaagcaggagctgccgcggagcgtgcacgggctgagcg

SEQ ID NO: 6147 - DNA, 201 bp, Homo sapiens
gccagaggggtctcattcatggcttggggacacagggctcctagcaagcaggaagttaagagcaggaggaagcgttgctaccttcacttctccccagctcygccctctgggtccacatgaggacagggaagctcgggaaggggaagggagactggccctgcccagccggtctctagcccctcagcccccgctgggcactct

SEQ ID NO: 6148 - DNA, 201 bp, Homo sapiens
ctgtcctcacctaccagtacctgccctacatcagctacctggtcagtcgctggtttggcaggcccggggctgggaaggctgaggacctgagggccggcccrggctctcttggtgccagggggtctgtggggctgcccggccctcatctgctcggtggctctaggtggccccagggagtgcctcaggccccagccgactgaa

SEQ ID NO: 6149 - DNA, 201 bp, Homo sapiens
gaggctgaggcaagagaattgcttgaacctgggaggtggaggttgcagtgagccgagattgcaccactgcactccagcctgggcgacaaagcgagactccrtctcaaaaaaagagaaacatctttagcattttctaaggatccctgggggacgggaggcaggtgtgcggtgagttgggggattagaagctcccagggctct

SEQ ID NO: 6150 - DNA, 201 bp, Homo sapiens
ccaggtgctgggtcccagtctaagtgccagccttgggtagggccaggctgggcccccagctagagtgagctcaagcggccagcacagccctgcagggccargctacccccggccctccactggcgactcagggctgctggcccttccgtggcaggacccactcggcagcagttcacagtgagcagtggcgagagcccaccg

SEQ ID NO: 6151 - DNA, 201 bp, Homo sapiens
gaaaatcatccccaaccacgagctggttggggagctggcggcgctgtacttggagagcatcagccccagcagtcgcaaccctgccagcgtggagcccaccrtgcccggcaccgggcccgagtgggacccccatggtgggggctgccctcaggatgacggccactcagggacctttgggagcgtcctggtggggaaccgcat

SEQ ID NO: 6152 - DNA, 201 bp, Homo sapiens
caggttaaataaagctgagctgggaggctgtttactgcctgtagaccgctgagcagagtccatggccctgccgggctgccctggctgggggcaggagcacrcctgggcatggggatcctgtccccgtctccttcccctccccctccctccattctcagtcacaggcctcggggagctgctcagggaggcccaggaggggag

SEQ ID NO: 6153 - DNA, 201 bp, Homo sapiens
aaaaatatatataaaggccgagcgtggtgtctcacccctgtaatcccagcactttggggggccaaggcgggtggatcacgaggtcaggagtttgagacccrcctggccaacatggtgaaaccccgtctccactaaaaatacaaaatcttcgctgggcatggcagcaggtgcctgcaatcccaggttctcgggaggctgcaa

SEQ ID NO: 6154 - DNA, 201 bp, Homo sapiens
ctggagatggcatacacaatctacgtgcccttctcctgcctgttgggtactgccccatcacgttccccatcacagtcttcgtggctgtctcctcccttggraggccccattctctgcccttgccccagagtcagcagtgggttctaagagccagcaggatgggtgagagcaaagggatttggcctcagacccctaccccca

SEQ ID NO: 6155 - DNA, 201 bp, Homo sapiens
aggtgggcagatctgctgggccagggcgggctggggcgggggctgtggacctgggtgaccccctgggcatcttgctcataggatctgaagctggactccgygggccgtggcgaggaccagggtgggccagggtgggagctgtggacccggctgaccccctgggtgtcttgctcataggatctgaagctggaccctgcgggc

SEQ ID NO: 6156 - DNA, 201 bp, Homo sapiens; identical to SEQ ID NO: 4851

SEQ ID NO: 6157 - DNA, 201 bp, Homo sapiens
gttgtctgcccacccctaccacagtgtttgtgccttcagctgagggggcagcctctgggccctgaacccctgctggggctccacgaccctgagagaagggktgagaagaatcatctctgcacctcgggtctctgccagaggaagacttaagcatccctgcgacctcacattctagacagagatgaggtccaggggttggcc

SEQ ID NO: 6158 - DNA, 201 bp, Homo sapiens
agagaaggggtgagaagaatcatctctgcacctcgggtctctgccagaggaagacttaagcatccctgcgacctcacattctagacagagatgaggtccargggttggcccctgctgccttctcacaatttgcaatagatgtaaataggaccaataaatcctttggaagagccatggggtgaactgaggcttgtctttttt

SEQ ID NO: 6159 - DNA, 201 bp, Homo sapiens
gggtgggccgtgcagcagggcgcagcgaggcggacatccaaacagcggaactcagacgctgactccgagcgcaccccgggccttcccatttcatacacccwcgaggatgagacccaagcacctccaaggaatagcacccgaggtcttcaggacaccgaccggtagccatggccagatgcccggccaaccccttcagcgtgg

SEQ ID NO: 6160 - DNA, 201 bp, Homo sapiens
ttgagtcccgcctcctccagcccatccttcctacaggtgccccatccaaacacaaatctgaccgtgttactctcctgcttaagatacttcacaacttcctrtgtcctgtgggataaaatgcaaacacttgccatcagcacacaaggcaggttacagtgctgcctggcccacatctcccctggcttcagtcacactgaagaa

SEQ ID NO: 6161 - DNA, 201 bp, Homo sapiens
gcattctgtgtagcatcctacgtattcacccattctccatcttctccttcatgcagcagaccatgtgtcaacatatgcggagtttgtgcagacgcacagamcctctggggagtatatgtttgaatttgatgaggaggagcagttctacgtgaacctggatgagaaggagatggtctggcctctaccagagtttattcacac

SEQ ID NO: 6162 - DNA, 201 bp, Homo sapiens
tcttcccaccagtgctgaacatcacgtggctgcgcaatggggagccagtcattgagggtattgcagagaccatcttcctgcccagcaagaaactcagattmcacaggttccactatctgaccctcgttcccatggccgaggacacctgtgacctccagggggagcactggggcctgcaccagcctctcctcaggcactggg

SEQ ID NO: 6163 - DNA, 201 bp, Homo sapiens
ccatccttcctacaggtgccccatccaaacacaaatctgaccgtgttactctcctgcttaagatacttcacaacttcctatgtcctgtgggataaaatgcraacacttgccatcagcacacaaggcaggttacagtgctgcctggcccacatctcccctggcttcagtcacactgaagaactgcagttctccttgcaactt

SEQ ID NO: 6164 - DNA, 201 bp, Homo sapiens
cttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcatgtgatttagtgattcctgtggcctctcatgtca

SEQ ID NO: 6165 - DNA, 201 bp, Homo sapiens
cttctctcaatcacttaattatcacctttgcaggcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcatt

SEQ ID NO: 6166 - DNA, 201 bp, Homo sapiens
tcatggtttcgaatacccaacacctcccacatccaaggccagcccctgctctctgtaccttataactctgtcttcccttggtgccccagaggtccatgaamtaatccaggtgcctgagaccatggagatgctggtctgtgccctcggcctgctggtgggcctggcgggggtccttaatggcaccattgtctcaaagaccaa

SEQ ID NO: 6167 - DNA, 201 bp, Homo sapiens
cctgctctctgtaccttataactctgtcttcccttggtgccccagaggtccatgaactaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcat

SEQ ID NO: 6168 - DNA, 201 bp, Homo sapiens
gctcctctcagggtggcaactaatgacttttatacaactcaagccagtggtcactgttctgtttctgtcttatgtgtgtcattagtgtgtttgagatgccycctctcctctttcctggaagttttctcctgtctcttgtcttttatgaacccacttcctctctgttttcctaccaatttctagtcctctgcttttcagcct

SEQ ID NO: 6169 - DNA, 201 bp, Homo sapiens
gaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccacaagacaattttgtgaatgttatgtgaatgataata

SEQ ID NO: 6170 - DNA, 201 bp, Homo sapiens
actgttctgtttctgtcttatgtgtgtcattagtgtgtttgagatgccccctctcctctttcctggaagttttctcctgtctcttgtcttttatgaacccrcttcctctctgttttcctaccaatttctagtcctctgcttttcagcctctttcttcatgtctgtgtttgtctggatgcaggagcacacactcagatccct

SEQ ID NO: 6171 - DNA, 201 bp, Homo sapiens
cttcttatgtatcaggtaaagctaagatactatcccataggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcattttt

SEQ ID NO: 6172 - DNA, 201 bp, Homo sapiens
tgctcctctcagggtggcaactaatgacttttatacaactcaagccagtggtcactgttctgtttctgtcttatgtgtgtcattagtgtgtttgagatgcmccctctcctctttcctggaagttttctcctgtctcttgtcttttatgaacccacttcctctctgttttcctaccaatttctagtcctctgcttttcagcc

SEQ ID NO: 6173 - DNA, 201 bp, Homo sapiens
tccttttcctgtaatctggattttcgagttccccagtggggacatgggtccggaggcaggtttttcccctctcacgctttgggaacgcacagtttttcacytgtctggtggagtttgcagtggcccctcccttctttaaaaggatctgtgaattctttcgattttctgggtattctcctgcagtggttcctttcttgaggg

SEQ ID NO: 6174 - DNA, 201 bp, Homo sapiens
tttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcggagtttgtgcagacgcacagaccctctggggagtatatgtttg

SEQ ID NO: 6175 - DNA, 201 bp, Homo sapiens
gtgtcattagtgtgtttgagatgccccctctcctctttcctggaagttttctcctgtctcttgtcttttatgaacccacttcctctctgttttcctaccamtttctagtcctctgcttttcagcctctttcttcatgtctgtgtttgtctggatgcaggagcacacactcagatccctgctatcctgactttgtgtacttt

SEQ ID NO: 6176 - DNA, 201 bp, Homo sapiens
tttattaactgaatgaaaattaacatttgaagtgtggaatttgcttcaaaatgtgccaacctttagttttcagattttgtaaatataataaatacaaagtracctaagctgaaccaattacatctgtgtagcccagtctatacaccatgtatttttctttttcctttgggattcatttctgtaggtgagtaatcctctaga

SEQ ID NO: 6177 - DNA, 201 bp, Homo sapiens
tcctgttacctgtttgcttcctgcattctgtgtagcatcctacgtattcacccattctccatcttctccttcatgcagcagaccatgtgtcaacatatgcrgagtttgtgcagacgcacagaccctctggggagtatatgtttgaatttgatgaggaggagcagttctacgtgaacctggatgagaaggagatggtctggc

SEQ ID NO: 6178 - DNA, 201 bp, Homo sapiens
cctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatgg

SEQ ID NO: 6179 - DNA, 201 bp, Homo sapiens
caaaatgtgccaacctttagttttcagattttgtaaatataataaatacaaagtaacctaagctgaaccaattacatctgtgtagcccagtctatacaccrtgtatttttctttttcctttgggattcatttctgtaggtgagtaatcctctagaccctaaactcagtgggggaccctcaccatccgtgtgcggcactgaa

SEQ ID NO: 6180 - DNA, 201 bp, Homo sapiens
tcctgtctcggcctctcaaatcactgagattacaggtatgggccactgtgcccagcctattatcgattttctcccatttcattcagtcctcaacccaatgyactctctctttttctttccctcatctctgatgctcctctcagggtggcaactaatgacttttatacaactcaagccagtggtcactgttctgtttctgtc

SEQ ID NO: 6181 - DNA, 201 bp, Homo sapiens
ggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtctt

SEQ ID NO: 6182 - DNA, 201 bp, Homo sapiens
caactcaagccagtggtcactgttctgtttctgtcttatgtgtgtcattagtgtgtttgagatgccccctctcctctttcctggaagttttctcctgtctsttgtcttttatgaacccacttcctctctgttttcctaccaatttctagtcctctgcttttcagcctctttcttcatgtctgtgtttgtctggatgcagga

SEQ ID NO: 6183 - DNA, 201 bp, Homo sapiens
atcctctagaccctaaactcagtgggggaccctcaccatccgtgtgcggcactgaacctgctgtcacactatgcatctaagtagaggactggttctccccrtgctgggctgggaggggaaatcctcacttagggaccaccaaccatgcagtgtcatttggcttcacttcctcttccaggccgaaccctaaactctctgtaa

SEQ ID NO: 6184 - DNA, 201 bp, Homo sapiens
gtccagctggagggatgggagggcctctctgccacacatagaactagaggccatgatgcccactcatgaatgagccccttccctgagagcgagaaatcttrggtccacacagctgggttcttaggacagcagaggaggaggcattttcttcttactcaagagaaaggctgggctgagggggccaggtcaggagcacgagaa

SEQ ID NO: 6185 - DNA, 201 bp, Homo sapiens
ccatctgctgtcctcctcaccccatgttcctgccctggcctacgccttcattacttcccaccagagggcttaaaagtgctactggtcttgccttgagtccmgcctcctccagcccatccttcctacaggtgccccatccaaacacaaatctgaccgtgttactctcctgcttaagatacttcacaacttcctatgtcctgt

SEQ ID NO: 6186 - DNA, 201 bp, Homo sapiens
aagcgtctttcccaaggagcctgtggatctgggccagcccaacaccctcgtctgccatgttgacaagttcttcccaccagtgctgaacatcacgtggctgygcaatggggagccagtcattgagggtattgcagagaccatcttcctgcccagcaagaaactcagattacacaggttccactatctgaccctcgttcccat

SEQ ID NO: 6187 - DNA, 201 bp, Homo sapiens
taatctggtgtctgaggcctggcagcaccacactctcttcagtgagtcaggctcaagtctgagcacatctgcagagcttatgtttgctgtgttgctcatgkaaggcagggaatccaaaattgttttcttagagatggactctcactatgtttcctaggctgctttcaaactcctggcctcaagtgatcctcctgtctcggc

SEQ ID NO: 6188 - DNA, 201 bp, Homo sapiens
acatttgaagtgtggaatttgcttcaaaatgtgccaacctttagttttcagattttgtaaatataataaatacaaagtaacctaagctgaaccaattacakctgtgtagcccagtctatacaccatgtatttttctttttcctttgggattcatttctgtaggtgagtaatcctctagaccctaaactcagtgggggaccc

SEQ ID NO: 6189 - DNA, 201 bp, Homo sapiens
gagatggtctggcctctaccagagtttattcacacctttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcac

SEQ ID NO: 6190 - DNA, 201 bp, Homo sapiens
tagtgattcctgtggcctctcatgtcattactgccatcaaatccatctgctgtcctcctcaccccatgttcctgccctggcctacgccttcattacttccyaccagagggcttaaaagtgctactggtcttgccttgagtcccgcctcctccagcccatccttcctacaggtgccccatccaaacacaaatctgaccgtgt

SEQ ID NO: 6191 - DNA, 201 bp, Homo sapiens
ccaatggcagtaggctccttgggttctatccccttttggagcccccaccgaggtaagcgtctttcccaaggagcctgtggatctgggccagcccaacaccytcgtctgccatgttgacaagttcttcccaccagtgctgaacatcacgtggctgcgcaatggggagccagtcattgagggtattgcagagaccatcttcct

SEQ ID NO: 6192 - DNA, 201 bp, Homo sapiens
aattacatctgtgtagcccagtctatacaccatgtatttttctttttcctttgggattcatttctgtaggtgagtaatcctctagaccctaaactcagtgrgggaccctcaccatccgtgtgcggcactgaacctgctgtcacactatgcatctaagtagaggactggttctccccatgctgggctgggaggggaaatcct

SEQ ID NO: 6193 - DNA, 201 bp, Homo sapiens
ccttttgcagacatcctcctggttccaaggcatttgtctccgtttttttagtccaaaggatcccagtgtgtagatttcacctctgatgcttgcttttggtwgctgagcgttttgccaccttttattttgttttgttttgttttgtttttttggagacggagtctcactctgttgcccagactggggtgcagtggcatgatc

SEQ ID NO: 6194 - DNA, 201 bp, Homo sapiens
tttccttctggaagacatggcagtgtctgccttgcagcatgcatccaagaccttatctgtttctgtatcaaacattgtcaagatcagggcatgaagagccrgggcattcctgactcccccaacagatggcatctcttctttattataggtgacttctgggggaacagaaagcatactgatggcctgcaaagcatatcggga

SEQ ID NO: 6195 - DNA, 201 bp, Homo sapiens
ctccacctgggaagaaaggacctaagtgaataaaaaaataacctcagtgcagtgcagcatctcagaattagaaatagtcttagaagtcatgggatgcagctttttttttttttttttttttgagacaaggtctcactctgatgcccaggctggagtgcagtggcatgatctcagcttactgcatcctcaatctctgaggct

SEQ ID NO: 6196 - DNA, 201 bp, Homo sapiens
tatcaccatatatctttaggaaaaatgttagtttagttacttgtgcggtgcctagcattgagcagttgcttgactgtcataataattctgctgtctctacygtactcttgcatctggataactttgtctttcttacctttggagattcaagacaagttgaacaagaccaaggatgatattagcaagaacatgtcattcctg

SEQ ID NO: 6197 - DNA, 201 bp, Homo sapiens
agagctgacctcagctgtaagcactttgtcttctgcagcgtagaaatgtagtgacctacaagtgtcccatgcccaagttgggtgcattattttgtggtgayggtcacatgtttcataaagacttcctgagtcaaaaaatgacttttctcagttcatcttccatataactcctggccacagggattttgtatccaatggtat

SEQ ID NO: 6198 - DNA, 201 bp, Homo sapiens
gctcgagcccaggaattcgagaccagcctgggcaactaggtgaaaccctgtctctacaaaaaatacaaaagttagccaggcatggtggggtgtgcctgtartcccagctactttgggggatgaggtgggaggatctcttaggcctgggaggtggagattgcagtgagccgagatcacgccatggcactccagtctaggtga

SEQ ID NO: 6199 - DNA, 201 bp, Homo sapiens
ggctttgtttttttaggtctgtagctcattctttttgtttcatggtctaggttttgaactctttgttttcttaaattcatgttcttatgatattttcctawagtgagaaagttataaggggtttccttcatcccttagcttgtttccttctgtgttgggtttttattttgcatgctacatactaccttttcccctgccttt

SEQ ID NO: 6200 - DNA, 201 bp, Homo sapiens
gcttattatccaagaaattatcatttctagttttagagaatgatgaaactcatttgtgctttgaaatataacctgtatacatgtgcacagtaagtcatttrgctatttattgtcagactctgggagttcatagcaaacttagcaacattccatgtgcaaatttgcatatttttccccccatatcttacctacttgccttag

SEQ ID NO: 6201 - DNA, 201 bp, Homo sapiens
atggcttctatttttgcagatgagcagagtccagttgcatagaggtttagtgttgtgccacacatcacacagcttctaagtgagagctaaaattagagccraaggttttgattaccagtccagactttctaggacaccacagctgcctttctgtagaacagattaacatgactctcagagtccgcaagagtagtggtgagg

SEQ ID NO: 6202 - DNA, 201 bp, Homo sapiens
aagggtctggtgccacctcagggtgaaagctagttttgccactcacttatcttgcaggattcttgattttgctttgtttgggggtttagcaagtttctttmtgttaggttagtgataggtttaaattttttttttttgatgttttatcaagttttttagttatttcagttaggaaggttgctcaaggtatataatattgct

SEQ ID NO: 6203 - DNA, 201 bp, Homo sapiens
ttcctaaaggacattcgagaatctgtcactcaaatcatgaagaatcctaaagcgaagaccacaggaatggtagggacacttggagttttttttcttctctkggaaatttaggtgttggtggagagtttgaaggaatcatatgacccggagtctgttcctgcctctgcccctttgccacagacatcttttatttgttgactg

SEQ ID NO: 6204 - DNA, 201 bp, Homo sapiens
gggacctccaaattcctagtgtgctgcgtgtatgtctgttgaaggagctcatcacttgcacaaggaccagaatcacttttactgcagcatggccagttttstggccactgttcctagttatacctttgattcttttacacacacactgtagctgctgccaaggcaggatcaaagtccaaatactgccctcaaggatgtgct

SEQ ID NO: 6205 - DNA, 201 bp, Homo sapiens
tttttttatgagccactcatttttctgggaacctagggattctttgaggcctagattgaagttaagtctggaagttctcttcttccagagaagatttgtcrtacctttttgagttgctggggattgccaccacactggaaccaaattaagtcaaatccttagcttgtcattttgtaccacagaggtagtgtgaattctgac

SEQ ID NO: 6206 - DNA, 201 bp, Homo sapiens
ctctcagtctctagcctttctactctccaatccatcttgtacacagccatcaaattgctcttataaaatacttgttacctggctaatatttagttcaagaycttcctgggggtctctaatcattcaggcctgctactgccttctttattagacttttctaacctaatcttccatgatgcctttgagtaaatgcaccactcc

SEQ ID NO: 6207 - DNA, 201 bp, Homo sapiens
tttttttaatctgcttggttgttttttatagtccttttccttggcttaacttttgtttacttaaatatattacacataaatatgttgtattctgtgtctgwtaattccaatatccatgagccttacctgattctgctggcttcagtcatggttccttgtttccttatatttgtgattttattttatttatttattttttta

SEQ ID NO: 6208 - DNA, 201 bp, Homo sapiens
gctcactgcagccttgacctctctgggctcaagcgaccctcccacctcagcccccttgagtagctgggactacaggcatgcaccaccatgcctcgctaatwtttgtatttttagtagagatggggtttcaccatgttgcccaggctggtcttgaactcccaagctgaagtgatctgcctgccttggcttctcaaagtgctg

SEQ ID NO: 6209 - DNA, 201 bp, Homo sapiens
ctggttttacctgagccaaagtttaatttattattttgctgtaaactgaacctcatttagttgctattaggcataaagaaagggggaggacatcattatayttaaagaaacacatgaggattctttgttttacctgttctttcaagtagatggttgttagttttcgtaaactatgatagataaacttctgtttagatctgt

SEQ ID NO: 6210 - DNA, 201 bp, Homo sapiens
attctgaaataggattgccttctagattgagatctggaaataatctgcatgtaggaatgtgcccaccaaaagggtgatattccacatgctgcccctcagcrcctccctttccctcacgcctcatcctgcagtgactgaggcaggacctttcccttgtgcgagaggcagcctaaatcagagctctactcatttcctgcttga

SEQ ID NO: 6211 - DNA, 201 bp, Homo sapiens
caaactaagaacagacttcttttctctctctaaatgtaatgtttttatttttcacttgtatttctagaaggcctttgagccctacttagagattttggaaktatactccacaaaagccaagaattatgtaaatggacattgcaccaagtatgagccctggcagctaattgcatggagtgtcgtgtggaccctgctgatagt

SEQ ID NO: 6212 - DNA, 201 bp, Homo sapiens
tgagtgtgaagtcctgactttgcctctttctatcagtttgactgagcaagtcacttaacctttcttgacttcagttttccccatctatagagtgatactgyacactggtttcttttcttttctttttccccttcctttccttttcctttttcttttccttccctctccctctcctccctttgcctttgcctttccctttcc

SEQ ID NO: 6213 - DNA, 201 bp, Homo sapiens
ccggtaatttagattagctgctaatggtgttttctattattttggcctgagttacattattctcctcttccctgtcatttagtgtggctccccaaagtgcycatgctgcatttaacaaagcagccagttactttgggatgaagattgtgcgggtcccattgacgaagatgatggaggtggatgtgcgggtgagtccctctg

SEQ ID NO: 6214 - DNA, 201 bp, Homo sapiens
atcctcaatctctgaggctcagatgatccttccacctcagcctcctgagtagctgggacgacaggcacatgccaccatgcccggctgatttttgtatttaytttttgtagagatggtagtttgccatgttacccaggctggtatctaactcctgggctcaagggatccaaccgcctgccttggcctcccaaagtgctggat

SEQ ID NO: 6215 - DNA, 201 bp, Homo sapiens
ttgcatgctacatactaccttttcccctgccttttagtttgtttgcatagtttccttgccattttctctcatcttggggtggcattctccagacattgttmttatgcactgtgggtgcttcctgtctgagaccatttggctggggacaaagctcagccaaagctttgttctatctgtattagaataaccaggtctattctg

SEQ ID NO: 6216 - DNA, 201 bp, Homo sapiens
tgatattcactaaagataatcttcatctcaagtattttttatatgtgggcacttctaattttatacatttttctatttaaaaagcattacattttaaaatktgtacctgttttgacatttggcaaaaaggaaactgtacctatggttcagtttaaaacaaagaatcagcatggggagtttaccggaatgaggactgaaaca

SEQ ID NO: 6217 - DNA, 201 bp, Homo sapiens
ttaaaacaaagaatcagcatggggagtttaccggaatgaggactgaaacacttaggagttaaagcaattcaaggggcgtgtgtgtgtctctccctttctcygtcaatctctctcactctctctggctctctcacagacacagactcaaacacacacagccatatgtgtaatcattttttagtacaaaatattccctgtagc

SEQ ID NO: 6218 - DNA, 201 bp, Homo sapiens
tagccagacatttatcttcagaataatcacaccacattaaatcagtcttctcttttcagccctagtaaaagttttgtttaattctaagatgccatcatagdgaacaaccttaacttttatcctacataattatattcaaagctttatgtatttttgtttataattacacagtaattataaatgtttagtaccaacctgatg

SEQ ID NO: 6219 - DNA, 201 bp, Homo sapiens
agctgtaacactcaccgcgagggtccgcggcttcattcttgaagtcagtgagaccaagaacccaccaattccggacacagtagaagcccattgggcttttmaattttatttactctaatttcattctaaagaattctgttttgtagttctccttttattttattattattttttgagacagggtgtcactctgttgctcag

SEQ ID NO: 6220 - DNA, 201 bp, Homo sapiens
catctgcttgcatttttttgcaggcttatggagattttgcatggagtaaccccctgcatccagatatcttcccaggactacgcaagatagaggcagaaatygtgaggatagcttgttccctgttcaatgggggaccagattcgtgtggatgtgtaagtatatgcaaggggcatccaatagccttattttttaggttaaaat

SEQ ID NO: 6221 - DNA, 201 bp, Homo sapiens
gaataatcacaccacattaaatcagtcttctcttttcagccctagtaaaagttttgtttaattctaagatgccatcatagtgaacaaccttaacttttatsctacataattatattcaaagctttatgtatttttgtttataattacacagtaattataaatgtttagtaccaacctgatgacaaacactattttgttgaa

SEQ ID NO: 6222 - DNA, 201 bp, Homo sapiens
ttgaacttcatggctcattacaaccattttcaaaatttaactgcaactatcttcttataaattaagagagtttaatttgtgttccatagtgcgatgacaawaaaaaagtaaaaacaaaacaaaaaaaccctcatgcctaaatttagaatattgtattatgtagcaatccaaaacattcaaaacaaattaaatagtttaact

SEQ ID NO: 6223 - DNA, 201 bp, Homo sapiens
tcccattatctacaggatgaaactcaggttcttatgcagcagagaatacaagtttcttcatgagccagctcccacttattttttcttaactacttctcttyatttcccacataaacactaatcctgccttttctctttactaaatgtgtcatgcttttacgttgttttccttcccttccatcattcctcttgttccaaatg

SEQ ID NO: 6224 - DNA, 201 bp, Homo sapiens
gcagctactatcctctctttctggtatgacttttttccttttaacttttctacctagagaattttctttcatccttttaaccagcttaaattttgccctcygtcattatctttatcccttcagagttagatagtccttcctcagtgctccatcttggcactcatatgctttttgtggctattcccctgagaagttttcgtg

SEQ ID NO: 6225 - DNA, 201 bp, Homo sapiens
caacagtctgtttggatgactgaaaacacacaggtttacgatctgtaaagatagtaggtaagtgatttaatcttgttgtataggtaggccagagggcactygcagccttctgattgatttaatagattgttgaagattaagagttgacttaacatctctcttagaaaactgagaaatagctcattactaaggtgtgtttta

SEQ ID NO: 6226 - DNA, 201 bp, Homo sapiens
acatctgcttccggtgagacctcaggaagcttacaatcatggcggaaggcaaaacttgagcaggcacgtcacatggcaagagtgagagcaagaaagagagkggggggaggtcctaggcttataaacaaccggatctcacctgaactaactgagcaagaactcattcatgaaagatgcacccccgtgatccagtcatctccc

SEQ ID NO: 6227 - DNA, 201 bp, Homo sapiens
atgtcttgcagtttttattatagggctataaaggaaattctcttatgttctttgttttttggaacaagctggctgtcaaatacaaaataccccttcatgtygacgcttgtctgggaggcttcctcatcgtctttatggagaaagcaggatacccactggagcacccatttgatttccgggtgaaaggtgtaaccagcattt

SEQ ID NO: 6228 - DNA, 201 bp, Homo sapiens
gaaacatttacttaggtttacaggtttattttaagggatactgcaaaggttacaaatgaagagatgcatggggcaaggtataggggaaggggtgtggagcytccatgcctccctgggtgcaccaccctccaggaacctccatgtgttcagctatccagaggctctctgaaccctgtccttttgggtttttatggaggctta

SEQ ID NO: 6229 - DNA, 201 bp, Homo sapiens
taagtctctagctcagagaagaatgaagtttgcagttcgaaaaggccatgcaatagcagttcacttccccaaaatgctcagcccttgtaggatgccgttaggtcatctggaagttctgtatgccttcactgggagcgtagtgaagatgagagcctttcctttggctcttggagtaaactagctgacaggactttgagaact

SEQ ID NO: 6230 - DNA, 201 bp, Homo sapiens
aaagaaaagagggttaattggctcatggttctgcatatttgtacaaacatggcttcaacatctgcttccggtgagacctcaggaagcttacaatcatggcrgaaggcaaaacttgagcaggcacgtcacatggcaagagtgagagcaagaaagagagtggggggaggtcctaggcttataaacaaccggatctcacctgaa

SEQ ID NO: 6231 - DNA, 201 bp, Homo sapiens
cctaccttagcctgccaagtagctgggactacaggagtgtgccaccatgcctgctgcttttttgtttgtttgttttttaaatttttttgtagggatgggawcttgttatgttgctcaggctggtcttgaactcctggcctcaggggatcctcctgccttagcctcccaaagtgctgggattacaagtactttataatgtgt

SEQ ID NO: 6232 - DNA, 201 bp, Homo sapiens
taacacttttgtaggcttttcattgtgtatttttgtgtatgtgtgcatatagcagctactctgtagcagaggtgggtagagacacttaatagtatcatgtygcatgcagatgtcacatcggcctctgcaaaaactgtactgtcttgtttctgcattagacttaagtagtcatgtgaatatactgctatgtcacttttaata

SEQ ID NO: 6233 - DNA, 201 bp, Homo sapiens
atatggtgcctgatgaggcccacttcctggaaggtggccttcataaaagtggttcatagaaaatgtcttctcactgtatcttcacatggtagaaggggcamatttgctctctgggggtctcttttataaagtcactaatcttattcacgaggcctctgccttcatgatctaatgaccccccaaaggctccctcttcctcct

SEQ ID NO: 6234 - DNA, 201 bp, Homo sapiens
gccatgactaccagacttttcctcaggctccttggcatgttagtctgaattgttcttgagcactgtactactgacccaacaactgtgactagctggccacrccattcagggctggtgtggcatttatgtgtgtgtgtgtgtgtgtgtgtttttcctgtttgcccagcagtgcattgtgggttccaagagtgggtagtgtgt

SEQ ID NO: 6235 - DNA, 201 bp, Homo sapiens
gatttgcagagctgacctcagctgtaagcactttgtcttctgcagcgtagaaatgtagtgacctacaagtgtcccatgcccaagttgggtgcattattttktggtgatggtcacatgtttcataaagacttcctgagtcaaaaaatgacttttctcagttcatcttccatataactcctggccacagggattttgtatcca

SEQ ID NO: 6236 - DNA, 201 bp, Homo sapiens
gttttttagttatttcagttaggaaggttgctcaaggtatataatattgctagaaatagaagttccataattgttttttccatgttacagaccttcgtctrtttgaaagcccctttctccctgaatcttctctgccccacatttttctgggttactccgcttttcatatgatttcacagacttccaaccatcgcagtcatt

SEQ ID NO: 6237 - DNA, 201 bp, Homo sapiens
gtgtgtatacacatgtatgcatgagcacatatgggatggataaatagaccaaatagcttggtgcttaagagcgtaaccctggaaccagcctggattcataycttggtttgccacttaaagtatgcctttggcgagttacttctgtatgtcacagttcctgtatctctacaatggggatagtaatagtagtacagtacttac

SEQ ID NO: 6238 - DNA, 201 bp, Homo sapiens
tagttccttttaatattttggggtcagacagtgcaagctgtcgacagcagcttaaggagatacattagagtcttcctggcagttcttagaatgccttgtgmtagtgttgaatgggacctccaaattcctagtgtgctgcgtgtatgtctgttgaaggagctcatcacttgcacaaggaccagaatcacttttactgcagca

SEQ ID NO: 6239 - DNA, 201 bp, Homo sapiens
gaggaggctggaagaggaagatgcctagcacagaccttctgatgttggtgagccttttgcagacatcctcctggttccaaggcatttgtctccgttttttyagtccaaaggatcccagtgtgtagatttcacctctgatgcttgcttttggtagctgagcgttttgccaccttttattttgttttgttttgttttgttttt

SEQ ID NO: 6240 - DNA, 201 bp, Homo sapiens
tccctgtggtttcactgagggccatatctaagaagatcttcttgtattctaattatccttggctagagatgagaaaatcttagtgtggagtgagttctggygttctttaacaaatatattgctgaaacaatagcactgtgacaaatcgtgacatgtagcttctctccccaaacctactacccaagagccttttgctataag

SEQ ID NO: 6241 - DNA, 201 bp, Homo sapiens
gtgctgcgtgtatgtctgttgaaggagctcatcacttgcacaaggaccagaatcacttttactgcagcatggccagttttctggccactgttcctagttayacctttgattcttttacacacacactgtagctgctgccaaggcaggatcaaagtccaaatactgccctcaaggatgtgctgactttagcaatgccaacca

SEQ ID NO: 6242 - DNA, 201 bp, Homo sapiens
aaagcagccagttactttgggatgaagattgtgcgggtcccattgacgaagatgatggaggtggatgtgcgggtgagtccctctggagggcccactgtctrtgctgggccctgacagcagaagggccctcctgttgactagccgtttccagtcagatgggtctgactgcctttgattgtggcagccagaatatgaaaaact

SEQ ID NO: 6243 - DNA, 201 bp, Homo sapiens
atactcatgagggcagaaccctcctgatctaaatcacctcttaaagatcccacctctcaacactgttacaatggcaattaaatttcaacgtgagttttagrggggacattcaaatcataacaggtagttagccctgttgagtaatggagaaaggattgtattagttccaaggaaagatgcatcatccagtgtgggtctgga

SEQ ID NO: 6244 - DNA, 201 bp, Homo sapiens
gactatccaatcactctccatttttcagaaacagattctgaggcttagatacaaaaagttacatgtgtgtatgtgtgtgtgtgtgtgtgtgtgcgcgcgcrcgcgtgtgtgtatacctctgtcatttattcacttaacacatgcttattgagccacctgctcagtgtcaagtacttttctgggtgctggggatatggtggt

SEQ ID NO: 6245 - DNA, 201 bp, Homo sapiens
tgccaaggactatccaatcactctccatttttcagaaacagattctgaggcttagatacaaaaagttacatgtgtgtatgtgtgtgtgtgtgtgtgtgtgygcgcgcgcgcgtgtgtgtatacctctgtcatttattcacttaacacatgcttattgagccacctgctcagtgtcaagtacttttctgggtgctggggata

SEQ ID NO: 6246 - DNA, 201 bp, Homo sapiens
aacttagaaagtaacagaattggaagatccttagcttgccaaggactatccaatcactctccatttttcagaaacagattctgaggcttagatacaaaaavttacatgtgtgtatgtgtgtgtgtgtgtgtgtgtgcgcgcgcgcgcgtgtgtgtatacctctgtcatttattcacttaacacatgcttattgagccacct

SEQ ID NO: 6247 - DNA, 201 bp, Homo sapiens
ccaaggcaaaaggatcgcttcagctcaggaattaaagaccaaccggagcaacatagtgagacattatctctacaacaaatttaaaaattagccatgaggcygggcgcggtgactcatccctgtaatcccagcactttgggaggctgaggcgggtggatcacctgaggtccagagttcaagaccagcctgaccaacagggag

SEQ ID NO: 6248 - DNA, 201 bp, Homo sapiens
ctatgtatggaagctcagctttcatagcctgttctgttgcatgagtcgccatttatgtgaattaattttttaatttacaacttaaaaaatgtcttcacatscatagcatgcccaggcattgcccaggagtgtagcctctgctccctgccagtgtgggcctcttagactattgcagacatgctcgaaaggagtggctttccc

SEQ ID NO: 6249 - DNA, 201 bp, Homo sapiens
ttgtttatatttatcatgtacaacatatgttttgaaatatgtatacattgtgaaatgggtaaattgagctaattaacatgcattacctcccatatttttctttttttgtggttaggtatttacttctgttttcagttctgcagctcactatgccatacattttgcttagctaatagtagagacacagccatcttaggttct

SEQ ID NO: 6250 - DNA, 201 bp, Homo sapiens
caagaaatatttgatcattgtagaaaggtcattttactacacaaggaatatttgatcattgtagaaagatcctaattaactgcagttttaaatgttacttrtaattttgtaacctagacaatgtcaacattttggtatatattcttctagatatttttattttcacctttttattttgaaaaactttgaacctacattgag

SEQ ID NO: 6251 - DNA, 201 bp, Homo sapiens
cctgggcgacagagcgagactgtctcaaaaaaaaaaaaatttgtgttttattttcttttacgtcgcatttaatgaattatattgaaattttaaaacttgtrtctgcaggcatagtgttataatctttaaatgccatgtcagagtagcaaaagggattacagaatatttgttataaaaagagggcattgggtcatagagttg

SEQ ID NO: 6252 - DNA, 201 bp, Homo sapiens
atgtacaacatgaagttttcaaatgtgtaagttgtggaatggctcaatcaaactaacgtgattacctcacgtacttttttttttttttttttttttttttytgagatggagttttgctctgtcacccaggctggagtgcagtggcacgatctcggctcactgcaacctccgcctcctgggttcaagcgattcacttgcttc

SEQ ID NO: 6253 - DNA, 201 bp, Homo sapiens
cttcactgctttactgtgtgtgttatgtgtttgtatttttaaaattttgaaccatgtaaatatagtacttattcacaaacttaaatttaaaagtttttttwaaattttttaaacgaaagaaactctttgcaattggaaggcaagtgaggtggaagacacattgaatggttgctatatgccaggtcatatccatggaaattt

SEQ ID NO: 6254 - DNA, 201 bp, Homo sapiens
gattataggtgcacaccaccatgcctgggtaatttttgttttttaatagagatggggtttcgccgtgttagccaggctggtctcaaactcctaacctcagrtgatccacctgccttggtctcccaaagtgctgggattacttacaggcgtgagccgccgtgtccagccaagtttgtttgtttgtttgtttttgtcacttct

SEQ ID NO: 6255 - DNA, 201 bp, Homo sapiens
cagaattggaagatccttagcttgccaaggactatccaatcactctccatttttcagaaacagattctgaggcttagatacaaaaagttacatgtgtgtakgtgtgtgtgtgtgtgtgtgtgcgcgcgcgcgcgtgtgtgtatacctctgtcatttattcacttaacacatgcttattgagccacctgctcagtgtcaagt

SEQ ID NO: 6256 - DNA, 201 bp, Homo sapiens
tactttaaaaagtattattcattcactgggcaaataatttttttttctagaggaatacctttccaattttataacagtgaaggaaggaatgttttacttayagaaactgtactgaaactactgttctattaagcaagggttggagataagcacccctgtcccccttccctgcccaggcacacacatatacagatacagctt

SEQ ID NO: 6257 - DNA, 201 bp, Homo sapiens
agggaaccatagttgataaactacctagcagaaaggaccttagttccttttaatattttggggtcagacagtgcaagctgtcgacagcagcttaaggagayacattagagtcttcctggcagttcttagaatgccttgtgctagtgttgaatgggacctccaaattcctagtgtgctgcgtgtatgtctgttgaaggagct

SEQ ID NO: 6258 - DNA, 201 bp, Homo sapiens
aggccgtgctgattctgaagggagtgcggaggaggcaggaccctggtagcctcggcaccttcagcccgggttaggtggcctgggctgggctccccaccccsatcgcgcgcagacggggcgtttcccctagtttccacctgggtggaatgctttgtgggagtctgggtctggattagtttcatcagctgtgggagggaaacc

SEQ ID NO: 6259 - DNA, 201 bp, Homo sapiens
attttggggtcagacagtgcaagctgtcgacagcagcttaaggagatacattagagtcttcctggcagttcttagaatgccttgtgctagtgttgaatggsacctccaaattcctagtgtgctgcgtgtatgtctgttgaaggagctcatcacttgcacaaggaccagaatcacttttactgcagcatggccagttttctg

SEQ ID NO: 6260 - DNA, 201 bp, Homo sapiens
ttcttgctttagggattacatatgactttttagaactgtggagatgggcagattacttttccagaaatttttttagtacatctttcatgcctcagaagcayctaggggaatataattgggagttgggtagacaggttcgaagtcagtgattgagtcattagatctagatggggtttgggccttggaattccatttttattg

SEQ ID NO: 6261 - DNA, 201 bp, Homo sapiens
atgctcatagctcaatgcagcatcaaatgcctgggctcaagtgatcctcctaccttagcctgccaagtagctgggactacaggagtgtgccaccatgcctrctgcttttttgtttgtttgttttttaaatttttttgtagggatgggatcttgttatgttgctcaggctggtcttgaactcctggcctcaggggatcctcc

SEQ ID NO: 6262 - DNA, 201 bp, Homo sapiens
tttcacattgctgataataatgatttttcatctttattttattgtgctaactctattgaacttttttcttgatttgctataagaatgctgttgggtttccwctcaacatttttttcttttgtatccagaggagtttcttcctgtttcttctttatcagaacctgtcttcccagagattcttgcttactgaccagtgacctt

SEQ ID NO: 6263 - DNA, 201 bp, Homo sapiens
aataaataagcaaacaaataaataaaaattagatatatataaaaggtcctcctatagctctgatagggccatttattaagacctgctataccatttcttgstttagggattacatatgactttttagaactgtggagatgggcagattacttttccagaaatttttttagtacatctttcatgcctcagaagcatctaggg

SEQ ID NO: 6264 - DNA, 201 bp, Homo sapiens
tgaccatacaaccttcactcacttagcactgtgcagtaatccactgagcaaaattgccacattttccttggcagggaatctgtgtgcctgtggcagttcaraaattatttgtagagtgggtcagcctgtcagcaggaatgtttttctttgatcttcagcctgtttttctttaatgtgagcagaacagtaaagagagaatac

SEQ ID NO: 6265 - DNA, 201 bp, Homo sapiens
ttgcctcatccatctttggccagtggaaacatcatattggctcctaggtccatttacatgacccaagtaatctttgaaagccttttttctctttctttccttttttttttttttttgacgaaatattccaggttcaggttcactttgtccatttcctgctccaggccttcaatcagccatttatccaaggagccctggttc

SEQ ID NO: 6266 - DNA, 201 bp, Homo sapiens
gcccccttgagtagctgggactacaggcatgcaccaccatgcctcgctaatttttgtatttttagtagagatggggtttcaccatgttgcccaggctggtsttgaactcccaagctgaagtgatctgcctgccttggcttctcaaagtgctgggattacaggcgtaagccaccacgcttggccgtcttttttttttttttt

SEQ ID NO: 6267 - DNA, 201 bp, Homo sapiens
tgtacagggcagcccccccccacccaccaaacacagaattatctggctggaaatgtcaaaatggccaaggttgagaaccctgacttaaccctttctccaaygtaactggccaaaggagagatgagaagcctgttaaggaagtaagaatttgagaaaacctgactgtattgttaggtgctttggaacaacatgcagctggct

SEQ ID NO: 6268 - DNA, 201 bp, Homo sapiens
gctggtcttgaactcccaagctgaagtgatctgcctgccttggcttctcaaagtgctgggattacaggcgtaagccaccacgcttggccgtcttttttttktttttttttttttaatctgcttggttgttttttatagtccttttccttggcttaacttttgtttacttaaatatattacacataaatatgttgtattctg

SEQ ID NO: 6269 - DNA, 201 bp, Homo sapiens
ttaccactttaaccatttttaagtgtacagttagtcctgtggcagtaagtacgttcacattattgtacaggcatcactattaccagaactttttcatcacyccactggaactccattttaataaacatcaaataataactgcccattactctctcccgcatcccctggaaaccaccatttattgtatcgccttgttttaca

SEQ ID NO: 6270 - DNA, 201 bp, Homo sapiens
aaattcaagttttggtgtccgtaattacattgtgttggaacacagccatgttcctttgtttacacaataactgactatatttgtactccagcagcagagakgagtagttgtaaaggagaatgtttgctttgcaacacttaaaatataaaataatttagtatcaagctcattacagaaccagtttgctgactactggggtag

SEQ ID NO: 6271 - DNA, 201 bp, Homo sapiens
actcttgcatctggataactttgtctttcttacctttggagattcaagacaagttgaacaagaccaaggatgatattagcaagaacatgtcattcctgaargtggacaaagagtatgtgaaagctttaccctcccagggtctgagctcatctgctgttttggagaaacttaaggagtacagctctatgggtatgatgcttg

SEQ ID NO: 6272 - DNA, 201 bp, Homo sapiens
ggaagccttcttctcattctcactgaggtgcctgtctttggtaggcaaccgttagccagctctgccttgtgttgctctcatccaaagtctctgtcccccarctttccgcctgccagcctagctttatgctttggatccctcactgtgggatcacttctgagtcctcttcctattgccagaatgatttcctaaataggaggg

SEQ ID NO: 6273 - DNA, 201 bp, Homo sapiens
tttatatggtccttgtgctaagaatgatttttacattttaaaaattgttaaagaatattttatgaacatgaaaattatatgaaattcaagttttggtgtcygtaattacattgtgttggaacacagccatgttcctttgtttacacaataactgactatatttgtactccagcagcagagatgagtagttgtaaaggagaa

SEQ ID NO: 6274 - DNA, 201 bp, Homo sapiens
atgaacaataataaaacaacgataccagattaggatataaaccatttatctctaactctacgcttcaccctgttacaaatatttcctttcttcccctctakggataaccccatcctgacttttataattattcccttgcctttttaaaaatagttttaaccacctgtgtatgcatcctaagtttagtttgtttttttttaa

SEQ ID NO: 6275 - DNA, 201 bp, Homo sapiens
tgttcttacactggcattttctattttgttaaacttaaaattctttttttaaagtaacaaataaaaattgtatgtttatgatgtacaacatgaagttttcmaatgtgtaagttgtggaatggctcaatcaaactaacgtgattacctcacgtacttttttttttttttttttttttttttttgagatggagttttgctctg

SEQ ID NO: 6276 - DNA, 201 bp, Homo sapiens
atgatctatacccacacccgaaaaaattactcacatacttaaaaatccatgccttttgttttgttttattgctgttgtttgtaatttacttatttttaccygatactatgttctggaaatttttctacgtagttcatgtagatctgtcttcttcttaatgtttcatggtatgggtacataaaatgcacgtattatagttta

SEQ ID NO: 6277 - DNA, 201 bp, Homo sapiens
atttgctctctgggggtctcttttataaagtcactaatcttattcacgaggcctctgccttcatgatctaatgaccccccaaaggctccctcttcctcctwccatcagcttgagggttagatttcaacatatgaatttttgggggatgtaaacattcagtccattgcaggtataaatgttttcaacaagcatttgttgagt

SEQ ID NO: 6278 - DNA, 201 bp, Homo sapiens
tgtgacctgtaggcctcaatgtcttcatctgtgaaggacaggttcagctctgatggcctatgatgtgatgaaccttgtgaacttgtaggcagagtgccackgtgtgcagagtccagttacagataaccagccattctcctctgcagattcaacccactgccactgtgtcttgttaagcttaaataggagagatgtgggaga

SEQ ID NO: 6279 - DNA, 201 bp, Homo sapiens
gacctcctttgaatttaagaattgccattatcttcataagaatcaaaacaaatacaaagaaaatatattcttgctgaatgtaatttttaaatgttagtgargaatgtctttatatcttaattttaaggcttttaaaaattagtttgcatttgctggttctttgctgtcaccctaatactggttatgttacttttttgctca

SEQ ID NO: 6280 - DNA, 201 bp, Homo sapiens
ctctggaaaactaggcagtggaaaaaacaatgcattttaaaccagaagatttgagtcctggctccgctatttccgagctttgtgacctgtaggcctcaatrtcttcatctgtgaaggacaggttcagctctgatggcctatgatgtgatgaaccttgtgaacttgtaggcagagtgccacggtgtgcagagtccagttaca

SEQ ID NO: 6281 - DNA, 201 bp, Homo sapiens
ctgttggtctcctgatttgtgccactgatagtttggctctggaaaactaggcagtggaaaaaacaatgcattttaaaccagaagatttgagtcctggctcygctatttccgagctttgtgacctgtaggcctcaatgtcttcatctgtgaaggacaggttcagctctgatggcctatgatgtgatgaaccttgtgaacttg

SEQ ID NO: 6282 - DNA, 201 bp, Homo sapiens
aagaagaagatagattctcttgggggctgtgcctctagtttgaaaccagggaaggcacattttggtattagtctgtggcctcagtttcttcatcactgcartgagattggactataggtggtctctaaggttccttcagacagtagcattttatgattttgaagacaacttttctgaagtacttttcaaactaatttcttt

SEQ ID NO: 6283 - DNA, 201 bp, Homo sapiens
tgcctttctgtagaacagattaacatgactctcagagtccgcaagagtagtggtgaggtgtcagttcaggggaatactcaaaggtcactgtccttttcagrtatctgggtagttgctacagtatgtgcttaggaattgctggataaaaaaatattctttaaaatctcatcattttagtcgttaataatttattattataac

SEQ ID NO: 6284 - DNA, 201 bp, Homo sapiens
aaggtgagctaaggaggagatcaagtgttaccagttgattattttgactattattgataaaataaattggtagcttccccgcaaagtataaaattaactayagaattctcatcagatgcttgttttaaactctctctttgccgtcaccagatcagctggttcaggtgatggggtatagtggtagaggtgacaagcagtagt

SEQ ID NO: 6285 - DNA, 201 bp, Homo sapiens
tttttgtatttattttttgtagagatggtagtttgccatgttacccaggctggtatctaactcctgggctcaagggatccaaccgcctgccttggcctccyaaagtgctggattacaggcatgagccactgtacctggcctgtgatgcagcttatattatacatgaatctgttgaagagtatctctggtaaatggatatcc

SEQ ID NO: 6286 - DNA, 201 bp, Homo sapiens
ccaaatttacaatatttgtagccttctgctgttgggtacattcatgaaaaggtcttgcatccttaaagtgaaggctgaaagagttttatgtcattggggcragtgggctaccaagctcccataaattctaggagctgccttttgtctaacgattaggattattgagtactattttgatgccttttgggtatcatctgaaat

SEQ ID NO: 6287 - DNA, 201 bp, Homo sapiens
atttctagttttagagaatgatgaaactcatttgtgctttgaaatataacctgtatacatgtgcacagtaagtcatttagctatttattgtcagactctgrgagttcatagcaaacttagcaacattccatgtgcaaatttgcatatttttccccccatatcttacctacttgccttaggctgggagtctattttcctaca

SEQ ID NO: 6288 - DNA, 201 bp, Homo sapiens
aaagctagttttgccactcacttatcttgcaggattcttgattttgctttgtttgggggtttagcaagtttctttatgttaggttagtgataggtttaaattttttttttttgatgttttatcaagttttttagttatttcagttaggaaggttgctcaaggtatataatattgctagaaatagaagttccataattgttt

SEQ ID NO: 6289 - DNA, 201 bp, Homo sapiens
tttgtatattcacagttgtgcagccatccccacgatcaattttaggacattttccaaagaaacccagtactcagcagtcacttccttatttccttctcacyggtcctcagcaactaccagtctactttgtgtagatttgcttagtcaggacacttcatataaatacaatcatacagtaaatatgtggtctttcctgattga

SEQ ID NO: 6290 - DNA, 201 bp, Homo sapiens
ctgctatcagttatctacaactttcagagccgtaaacagcctcctcataatcagaatctggtaacccggaggggcgtcccagataatgcataatttttcaytggaagccgtagggaaaaactctctcctctactctcacaccacaacaatcaacaccgaagacttccgtgaccaaacgtgtgggatttttttccccacact

SEQ ID NO: 6291 - DNA, 201 bp, Homo sapiens
aagctagttttgccactcacttatcttgcaggattcttgattttgctttgtttgggggtttagcaagtttctttatgttaggttagtgataggtttaaattttttttttttgatgttttatcaagttttttagttatttcagttaggaaggttgctcaaggtatataatattgctagaaatagaagttccataattgtttt

SEQ ID NO: 6292 - DNA, 201 bp, Homo sapiens
tttcgaagatgcactttccaaagggtgtttatatagttgaaggtcagtcagagacctagggataggtccctgcttattcttttgagcaggcttacgtgttrgaaatctctagagaaatagctttagttaggttacacttctcagcaaatattcagtattcctcatctctaatagcagcatgactgttgtagggaaggaatt

SEQ ID NO: 6293 - DNA, 201 bp, Homo sapiens
tgactcatccctgtaatcccagcactttgggaggctgaggcgggtggatcacctgaggtccagagttcaagaccagcctgaccaacagggagaaccccgtytctactaaaaatacaaaattagccgggtgtggtggcgcatgcctgtaatcccagctactcaggaggctgaggcaggagaattgcttgaacccgggaggca

SEQ ID NO: 6294 - DNA, 201 bp, Homo sapiens
gggaggctgaggcgggtggatcacctgaggtccagagttcaagaccagcctgaccaacagggagaaccccgtttctactaaaaatacaaaattagccgggygtggtggcgcatgcctgtaatcccagctactcaggaggctgaggcaggagaattgcttgaacccgggaggcagaggttgcggtgagttgagatggcacca

SEQ ID NO: 6295 - DNA, 201 bp, Homo sapiens
ggttagattgcattcattataaggaagactttgaatgattaaagagatagtgaccaggggattgtatgtgactgaatttactttttcttccttcatttatttttttgttttaagactggaaaatatcaaaggcatctttgtttttgggaatccccaattgtcagtcattgctctgggatcccgtgattttgacatctaccg

SEQ ID NO: 6296 - DNA, 201 bp, Homo sapiens
ttgatgttttatcaagttttttagttatttcagttaggaaggttgctcaaggtatataatattgctagaaatagaagttccataattgttttttccatgtkacagaccttcgtctatttgaaagcccctttctccctgaatcttctctgccccacatttttctgggttactccgcttttcatatgatttcacagacttcca

SEQ ID NO: 6297 - DNA, 201 bp, Homo sapiens
acccccactggctttatggaaagaatattgaagaagaagatagattctcttgggggctgtgcctctagtttgaaaccagggaaggcacattttggtattaktctgtggcctcagtttcttcatcactgcaatgagattggactataggtggtctctaaggttccttcagacagtagcattttatgattttgaagacaactt

SEQ ID NO: 6298 - DNA, 201 bp, Homo sapiens
tggtcacagcttggatggaggggtgctcttggcatgtaatggatcgtgtccagaaatgctgctaaacactaaacatcctacagtgtacagggcagcccccscccacccaccaaacacagaattatctggctggaaatgtcaaaatggccaaggttgagaaccctgacttaaccctttctccaatgtaactggccaaaggag

SEQ ID NO: 6299 - DNA, 201 bp, Homo sapiens
gttggtctcgaactcctgaactcaggtgatctgcccaccttggcctcccaaagtgctaggattacaggtgtgagccactgtgctcggccttgacaaatacycttacaatttctaagtgacatgtgttgaggtcttgacattgaatagtacaaaatttgatatagtctaggatgtagatgaataaagcagtggttagcactc

SEQ ID NO: 6300 - DNA, 201 bp, Homo sapiens
catccataaagcaagcaaatctcagagacagtggaacttggcttttatttccttttgtaagcatgaataaaacaaatatatttgtgtttaagaagagagartataagatatgtaatacaaatgaaatacagatccatgtaaaaatgtgaaatctgcataaaggcacaaaagaaaataagtcactataattccactatcaaa

SEQ ID NO: 6301 - DNA, 201 bp, Homo sapiens
agcatttcagctgacacccataaggtgagctaaggaggagatcaagtgttaccagttgattattttgactattattgataaaataaattggtagcttcccygcaaagtataaaattaactatagaattctcatcagatgcttgttttaaactctctctttgccgtcaccagatcagctggttcaggtgatggggtatagtg

SEQ ID NO: 6302 - DNA, 201 bp, Homo sapiens
atgtagcaatccaaaacattcaaaacaaattaaatagtttaacttatgtgacaggcagataagcatttcaaaagcataatgaagtccaattatgtagtgcwtaatgtagacaggagaagaatctaacattatgcagacattttctaaataaaagctccctgtaggacagctatatataaacatgggtaaggtaagcgcaga

SEQ ID NO: 6303 - DNA, 201 bp, Homo sapiens
tggccctaggcagtcatcactttctgaagacaacatacatgttgcatgaagtgctttcactggaaaagttgtcattcattccttgactgtaatgtataatrctatttggaactaactggtaaagaaccaataaccatggctgggttttcagtggcacactaacccatcattctatgaggtgtttctcaagctactttatat

SEQ ID NO: 6304 - DNA, 201 bp, Homo sapiens
ggtgctcagaattgttacttaacagaatcagcatctccctttacttgatgccttgtcctgaccacaagtacattaataaagtgaccatttagcagtgtttygggttcagcttttaggaacttagaagctgtggttttccatgagtgcacttctgatgacttgggaacatttcatatgtgtgttctttctgtggccaagatg

SEQ ID NO: 6305 - DNA, 201 bp, Homo sapiens
gagtaacatttgaactgggtagaacagatttttcttttcctcaacagcccattcctgctgtaaagctcagatttatggtccttctggaaaaagtattgagygttgaatagttcaggaaaacaaataacaaattctgtcttctttgcaggattgtggggtagaagattttgatttttattagtatctggccaaagaataaat

SEQ ID NO: 6306 - DNA, 201 bp, Homo sapiens
tggatgtcttttccctgctgcgtgaataccgggtagccattaagtttggtgattgggtgtcagtaatatgttaagtcagctactgggtcatcttttaatamaagaaaaggatggggaagagaatggattcttaagcagtgttgcctgtcagaatcaccggagggaggtttacaaaatacacattctgtactctgaccctgt

SEQ ID NO: 6307 - DNA, 201 bp, Homo sapiens
tttgcagttcgaaaaggccatgcaatagcagttcacttccccaaaatgctcagcccttgtaggatgccgttaggtcatctggaagttctgtatgccttcaytgggagcgtagtgaagatgagagcctttcctttggctcttggagtaaactagctgacaggactttgagaactgttggtctcctgatttgtgccactgata

SEQ ID NO: 6308 - DNA, 201 bp, Homo sapiens
tactgctatgtcacttttaatattacgagttttatacttggaaaatggtacttgcttcttttaaatctctgtcttctctaacctcccccttcccatttcartgctcccttcctaatttcagcaataatctcaaaaagcaattaaatagttaaatgaccctaattgtaattactgtggatggttgcattcatttgattactt

SEQ ID NO: 6309 - DNA, 201 bp, Homo sapiens
attgaatatacatccagatgtggaagaagtattagcagcctcaggaatgtgtaccttgttttgattgcattttcagagcttgttttaaactcaagtatatkaaagacttgtttttcaaaatcggtgtgatctgcagccgattttcagtcagcatctgttttttccttaccatccagatagctcctgtgtccttttcccata

SEQ ID NO: 6310 - DNA, 201 bp, Homo sapiens
ttgccacctggaattattagatacaaagaacaagaccattagctttaaactctggcagaattaggtgacagcctcctagaccagtggttggtcatgaggtktttctctcagtctctagcctttctactctccaatccatcttgtacacagccatcaaattgctcttataaaatacttgttacctggctaatatttagttca

SEQ ID NO: 6311 - DNA, 201 bp, Homo sapiens; identical to SEQ ID NO: 4411

SEQ ID NO: 6312 - DNA, 201 bp, Homo sapiens; identical to SEQ ID NO: 4546

SEQ ID NO: 6313 - DNA, 201 bp, Homo sapiens; identical to SEQ ID NO: 4412

SEQ ID NO: 6314 - DNA, 201 bp, Homo sapiens; identical to SEQ ID NO: 4532

SEQ ID NO: 6315 - DNA, 201 bp, Homo sapiens; identical to SEQ ID NO: 4598

SEQ ID NO: 6316 - DNA, 201 bp, Homo sapiens
ctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctg

SEQ ID NO: 6317 - DNA, 201 bp, Homo sapiens
gtcggtcggtgtttaggaggtttagaggtagatacatctgaatgctgaccccgacttcaaccctcgccggctgagctgtttccccctccgtgccttgaggrtgataatacgataagatagtgcatgtcaagtgcttaggacatattgagcgctcggagttagttcaaacttggttcttcgacccctagccctgtctccgga

SEQ ID NO: 6318 - DNA, 201 bp, Homo sapiens
tcggtcggtgtttaggaggtttagaggtagatacatctgaatgctgaccccgacttcaaccctcgccggctgagctgtttccccctccgtgccttgaggakgataatacgataagatagtgcatgtcaagtgcttaggacatattgagcgctcggagttagttcaaacttggttcttcgacccctagccctgtctccggat

SEQ ID NO: 6319 - DNA, 201 bp, Homo sapiens
aaggactttaaaacttgggctggattctgcgtggtggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggt

SEQ ID NO: 6320 - DNA, 201 bp, Homo sapiens
ccacgtcccagagacaccctcgaggtttagactctgggagtgcgcctttaaaccggaggcctgggcacgacgcgggacgcctgggttctttccctggctgsagcctctcctcctcctccccgccctctgagaacccttgactcgacataggggcgctaagatgtcagggagttggctccccaggctcagcccgcgtttccc

SEQ ID NO: 6321 - DNA, 201 bp, Homo sapiens
tggaaggttgaggcggatgaatcacttgaggccaggagttcgagaccagcccggccaacatggcgaaaacccgtctctacaaaaattagccggtcgtggtsgtgggcgcctgtggtcccagctacttgggaggctgaggcaggagaatcgcttgagcctgggaggcagaggttgcagggagccgagatcccgccactgcac

SEQ ID NO: 6322 - DNA, 201 bp, Homo sapiens
ggggcgtgacctgggtcttggggcggccggccccgcctgcctccctctcggtcccggtagactagacggaagtgggacagagtagaagtcaaaggtgcctkagcgggtggggctgttgatcgcactttgaggggtgggagatggaggtggcagggggactgaattcaaggggagggaccctccggggctgtcactgctgca

SEQ ID NO: 6323 - DNA, 201 bp, Homo sapiens
ctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcacgacgcgggacgcctgggttctt

SEQ ID NO: 6324 - DNA, 201 bp, Homo sapiens; identical to SEQ ID NO: 4788

SEQ ID NO: 6325 - DNA, 201 bp, Homo sapiens
agatggaggtggcagggggactgaattcaaggggagggaccctccggggctgtcactgctgcaggaaaggactttaaaacttgggctggattctgcgtggyggaaacttgacccaattcacaatccactgtggggaagattggggagggaccaaagtcattggatgttggagggagagaggggtcaagatcgccttctctc

SEQ ID NO: 6326 - DNA, 201 bp, Homo sapiens; identical to SEQ ID NO: 4791

SEQ ID NO: 6327 - DNA, 201 bp, Homo sapiens
gcgcccccgggggccctcaacatcggcctgtcgagcaacaacagcacactgagcgtggcaggcgccatgggaagccacggcggcgagtacgagtgcgcagscaccaacgcgcacgggcgccacgcgcggcgcatcacggtgcgcgtggccggtaagtggcagctggggagaggcggggcgaggtatctgagagggggcgtg

SEQ ID NO: 6328 - DNA, 201 bp, Homo sapiens
ggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgcctcgactagcgtgacacctccttggatcggcgtccaagggttatgcaggg

SEQ ID NO: 6329 - DNA, 201 bp, Homo sapiens
ggggcgaggtatctgagagggggcgtgacctgggtcttggggcggccggccccgcctgcctccctctcggtcccggtagactagacggaagtgggacagartagaagtcaaaggtgccttagcgggtggggctgttgatcgcactttgaggggtgggagatggaggtggcagggggactgaattcaaggggagggaccctc

SEQ ID NO: 6330 - DNA, 201 bp, Homo sapiens
cgcgcccccgggggccctcaacatcggcctgtcgagcaacaacagcacactgagcgtggcaggcgccatgggaagccacggcggcgagtacgagtgcgcasccaccaacgcgcacgggcgccacgcgcggcgcatcacggtgcgcgtggccggtaagtggcagctggggagaggcggggcgaggtatctgagagggggcgt

SEQ ID NO: 6331 - DNA, 201 bp, Homo sapiens
tgcctcgccccctggaggcgtgcgcccaggaggaaacttcacgttgacctgccgcgcggaggcctggcctccagcccagatcagctggcgcgcgcccccgrgggccctcaacatcggcctgtcgagcaacaacagcacactgagcgtggcaggcgccatgggaagccacggcggcgagtacgagtgcgcagccaccaacgc

SEQ ID NO: 6332 - DNA, 201 bp, Homo sapiens; identical to SEQ ID NO: 4814

SEQ ID NO: 6333 - DNA, 201 bp, Homo sapiens
caaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtc

SEQ ID NO: 6334 - DNA, 201 bp, Homo sapiens
ccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgc

SEQ ID NO: 6335 - DNA, 201 bp, Homo sapiens
accttctgtgcccttcagaccggccagtggtggccgaacttgctgcctcgccccctggaggcgtgcgcccaggaggaaacttcacgttgacctgccgcgcrgaggcctggcctccagcccagatcagctggcgcgcgcccccgggggccctcaacatcggcctgtcgagcaacaacagcacactgagcgtggcaggcgcca

SEQ ID NO: 6336 - DNA, 201 bp, Homo sapiens; identical to SEQ ID NO: 4815

SEQ ID NO: 6337 - DNA, 201 bp, Homo sapiens
cgggcgctctcaggcacttaccgctgcaaggcggccaatgatcaaggcgaggcggtcaaggacgtaacgctaacggtggagtgtgagtgggggtgcgcagrgtgcatttctatctggttcaaggtctggagggtggccagcctccagggaagagtaggagtagggtatgaggtgtccctttgggtgaggttttgggaaagg

SEQ ID NO: 6338 - DNA, 201 bp, Homo sapiens; identical to SEQ ID NO: 4817

SEQ ID NO: 6339 - DNA, 201 bp, Homo sapiens
gagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcc

SEQ ID NO: 6340 - DNA, 201 bp, Homo sapiens
ccgcgggggccggcctggccttctacgtgcagtccaccgcctgcaagaagggcgagtacaacgtgcaggaggccgagagctcaggcgaggccgtgtgtctsaacggagcgggcggcggcgctggcggggcggcaggcgcggagggcggacccgaggcggcggggggcgcggccgagtcgccggcggagggcgaggtcttcg

SEQ ID NO: 6341 - DNA, 201 bp, Homo sapiens
ccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctc

SEQ ID NO: 6342 - DNA, 201 bp, Homo sapiens
cgagtacaacgtgcaggaggccgagagctcaggcgaggccgtgtgtctgaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggg

SEQ ID NO: 6343 - DNA, 201 bp, Homo sapiens
gtaagagccccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagccccta

SEQ ID NO: 6344 - DNA, 201 bp, Homo sapiens
catcggcgctttggagaccatggctctctgctaccacgtcccagagacaccctcgaggtttagactctgggagtgcgcctttaaaccggaggcctgggcasgacgcgggacgcctgggttctttccctggctgcagcctctcctcctcctccccgccctctgagaacccttgactcgacataggggcgctaagatgtcagg

SEQ ID NO: 6345 - DNA, 201 bp, Homo sapiens; identical to SEQ ID NO: 4822

SEQ ID NO: 6346 - DNA, 201 bp, Homo sapiens
tcatcgaggggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcc

SEQ ID NO: 6347 - DNA, 201 bp, Homo sapiens; identical to SEQ ID NO: 4823

SEQ ID NO: 6348 - DNA, 201 bp, Homo sapiens
ggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccct

SEQ ID NO: 6349 - DNA, 201 bp, Homo sapiens
accaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagctt

SEQ ID NO: 6350 - DNA, 201 bp, Homo sapiens
ctctcaggcacttaccgctgcaaggcggccaatgatcaaggcgaggcggtcaaggacgtaacgctaacggtggagtgtgagtgggggtgcgcagggtgcayttctatctggttcaaggtctggagggtggccagcctccagggaagagtaggagtagggtatgaggtgtccctttgggtgaggttttgggaaagggaagag

SEQ ID NO: 6351 - DNA, 201 bp, Homo sapiens
acacgggggcttatttattgctttatttatttacttattcatttatttatgtattcaactccaagggcgtcacccccattttctacccatcccctcaataragtttttataaaggaactccctgtctccgcttctgtttctgcaaggtggaacaagcccagggttccagtcgtgacctcccgagttattcattcaaaaagc

SEQ ID NO: 6352 - DNA, 201 bp, Homo sapiens
ggtaagtggcagctggggagaggcggggcgaggtatctgagagggggcgtgacctgggtcttggggcggccggccccgcctgcctccctctcggtcccggkagactagacggaagtgggacagagtagaagtcaaaggtgccttagcgggtggggctgttgatcgcactttgaggggtgggagatggaggtggcaggggga

SEQ ID NO: 6353 - DNA, 201 bp, Homo sapiens
ttgggcggagtcgtggaaaggcgggcagtccagagtgtttaagtttttagacgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtca

SEQ ID NO: 6354 - DNA, 201 bp, Homo sapiens
acgccccccagactcacacgggggcttatttattgctttatttatttacttattcatttatttatgtattcaactccaagggcgtcacccccattttctasccatcccctcaataaagtttttataaaggaactccctgtctccgcttctgtttctgcaaggtggaacaagcccagggttccagtcgtgacctcccgagtt

SEQ ID NO: 6355 - DNA, 201 bp, Homo sapiens
ttatttattgctttatttatttacttattcatttatttatgtattcaactccaagggcgtcacccccattttctacccatcccctcaataaagtttttatraaggaactccctgtctccgcttctgtttctgcaaggtggaacaagcccagggttccagtcgtgacctcccgagttattcattcaaaaagcgatttttgag

SEQ ID NO: 6356 - DNA, 201 bp, Homo sapiens
gcagctggggagaggcggggcgaggtatctgagagggggcgtgacctgggtcttggggcggccggccccgcctgcctccctctcggtcccggtagactagrcggaagtgggacagagtagaagtcaaaggtgccttagcgggtggggctgttgatcgcactttgaggggtgggagatggaggtggcagggggactgaattc

SEQ ID NO: 6357 - DNA, 201 bp, Homo sapiens
ctggggagaggcggggcgaggtatctgagagggggcgtgacctgggtcttggggcggccggccccgcctgcctccctctcggtcccggtagactagacggwagtgggacagagtagaagtcaaaggtgccttagcgggtggggctgttgatcgcactttgaggggtgggagatggaggtggcagggggactgaattcaagg

SEQ ID NO: 6358 - DNA, 201 bp, Homo sapiens
ggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacggtggaat

SEQ ID NO: 6359 - DNA, 201 bp, Homo sapiens
gtggcaggcgccatgggaagccacggcggcgagtacgagtgcgcagccaccaacgcgcacgggcgccacgcgcggcgcatcacggtgcgcgtggccggtamgtggcagctggggagaggcggggcgaggtatctgagagggggcgtgacctgggtcttggggcggccggccccgcctgcctccctctcggtcccggtagac

SEQ ID NO: 6360 - DNA, 201 bp, Homo sapiens
cgtggcaggcgccatgggaagccacggcggcgagtacgagtgcgcagccaccaacgcgcacgggcgccacgcgcggcgcatcacggtgcgcgtggccggtmagtggcagctggggagaggcggggcgaggtatctgagagggggcgtgacctgggtcttggggcggccggccccgcctgcctccctctcggtcccggtaga

SEQ ID NO: 6361 - DNA, 201 bp, Homo sapiens
tggcaatattgctttcctacaattatatgttccagttatagtaaagagatactagtaaaaacaaaaaaatctctttttttgccccctagaattttataaaytgtgtttgcttgtccaatttaggaagcgctatagaaatgaagggagtcccagccctagacagtccccgaagcgccggcgtgaacattctccggacagtga

SEQ ID NO: 6362 - DNA, 201 bp, Homo sapiens
cattaaaggatgggttaatttaagggttgtctttaacattttttattctgagattgaaactttggaaattacagttgacccttgaacaatgaaggggtagrgggtcaacccctgtgcagttgaaaatccttgtataacttttgactccccccaaacttagctactaatagcccactgttaactggaaactttactgataac

SEQ ID NO: 6363 - DNA, 201 bp, Homo sapiens
actcccagaaaaaagaagatacagcattcagtgactggtctgatgaggatgtccctgaccgtacagaggtgacagaagcagagcatactgccaccgccacractcctggtagtaccccttctcctctatcttctcttcttcctcctccaccgcctgtggctactgccactgctacaactgtgcctgcaactcttgctgcca

SEQ ID NO: 6364 - DNA, 201 bp, Homo sapiens
attctcctgcctcagcctcccgagtagctgggactacaggcgcccaccaccacgcccagctaattttttttttgtatttttagtagagatggggtttcacygtgttagtcaggatggtgtcaatctccttaccttgtgatcctcccatctcagcctcccaaagtgctgggatgacaggtgtgagccaccgcgcccggcctg

SEQ ID NO: 6365 - DNA, 201 bp, Homo sapiens
ctacagataaatcttttgcgaaaggaagagtcaattggtgtgacaaacttcatcattgtcttcttttaagaaattgccacagcctccccagccttttgcarccttcatcctcgtcagtcaacagccatcagcatcaagataatacccttacccacaaaacggttaaaactctctgaaggcttagatgggtgttagcatttc

SEQ ID NO: 6366 - DNA, 201 bp, Homo sapiens
gaaagcagagtcctccaagacatcgctctccaatgcgagagaaagggagacatgatcatgaacgaacttcacagtctcatgatcgacgccacgaaaggagrgaaggtgtgtactgtactttgatttttttaattgaaaaattgaacatccagctttattgttgtactaagagatggagaaagactttgctatgttaagtct

SEQ ID NO: 6367 - DNA, 201 bp, Homo sapiens
tacccagtagtgggattgctggatcaaatatctccttttagttctttagggactctccatactgtttttcatagaggttgtacttatttacatacccaccrgcagtgaataagcattcccttttcaccatgtctatgctaacatctcctgttttttttactttttaatggccatttttgtaggagtaaggtggcatctcat

SEQ ID NO: 6368 - DNA, 201 bp, Homo sapiens
tcccaagtagctgggcttacaggcttgcgttgccacactcagctaatttttaaaatctttttgtagagatgaggtctcgctatgttgtccagactgatctygaactcctggactcaagtaatcctgccttggcctcccaaaacattgtagttataggcttgagccaccatgcccagccgactgcagttttgaaaattctac

SEQ ID NO: 6369 - DNA, 201 bp, Homo sapiens
atggaaatgacagagacatctaacatggaggagagatccaagagatacagtaactgtgtaataaagagaactgcagagacttgggtcataaggaaaagttwtgaaatgaaaatagaagaaattgagtaaaaagtttgaagtttcagattgaaacagtccatttagtgctggaaaagattttttgaaaatacctggatttag

SEQ ID NO: 6370 - DNA, 201 bp, Homo sapiens
tctataacatcctaagattcctttttattacccctttatagccacaaccctcccctggcccctggccccaacccctggcaacctcttatgtgtcctttgtyttgtaattgtctcgtaaatggaataatgctatatgtatcctgttgagattggctttttcactcagcataattttttcttggggttcatccaagttgttgc

SEQ ID NO: 6371 - DNA, 201 bp, Homo sapiens
tcctttggccaggtcttggtcacttggccatgcttaatttcaagaaagtgtagatagtatggtttaccactgtgctcagaagaaaagtttggtaaaccccytgctagtctctgtcacaggtgataatgtaaaaatagtttgtgtcaagaattcctttgttgtttaatcatgaaattttaaaagataattttgatacagatg

SEQ ID NO: 6372 - DNA, 201 bp, Homo sapiens
actcatctataacatcctaagattcctttttattacccctttatagccacaaccctcccctggcccctggccccaacccctggcaacctcttatgtgtccyttgtcttgtaattgtctcgtaaatggaataatgctatatgtatcctgttgagattggctttttcactcagcataattttttcttggggttcatccaagtt

SEQ ID NO: 6373 - DNA, 201 bp, Homo sapiens
ctaaccctatttcagactctacttaactttttgcctagattattatatcactaactatattgactttatgtagtttctacccaccacccacacaggtgaayattttcattcagctacctcaacccatttattttgtagatgctgtcagagaaatcttaaaaggacaattccaattaatttattataccattgaaaaactca

SEQ ID NO: 6374 - DNA, 201 bp, Homo sapiens
gagtttctgtctttgtttttgccagatattcctaaattatcacagccccagtactgtttctctactcctaaccctcactgctcaaaaaaagcttttttttwaatttcattttgttttgaagtaattaggaattcacaggagattgcaaataaatgtacagggaaactttgtttatccttaccccaacttctccagtgttaa

SEQ ID NO: 6375 - DNA, 201 bp, Homo sapiens
tttaaaaggtgagtgtaaatgtctttaataagaatttcttatgcttttccttgattgaaacgcacagtttttgaccattgtgtatctctgtgatttgaaartatctgttgagggaatattgaagcattgagttaagtgccccactccctggatagtgagactaaactggtttcatagacttaccttctgcattgttattct

SEQ ID NO: 6376 - DNA, 201 bp, Homo sapiens
tattttattttaattaaagtccataccctaattttatcttaaaaaaaatgaactaaaaatatcttctacctaagatttaatcagttaacaagccctgtctrtttgaacctgtaatgaaactcatatttatctccctccttctagttcctagaaactaaccctatttcagactctacttaactttttgcctagattattata

SEQ ID NO: 6377 - DNA, 201 bp, Homo sapiens
atgaaatctgacttacctgtttttgttttttttgttattattgttgcttgtttgtgcttttggtgtcatctaagaaactattgtttagtccagggtcacaragatttacgtctatgttgtctttgaagcattttctggttttagctcttatatttaagcctttgatacattttgagctaatttttatttatgatgtggtaa

SEQ ID NO: 6378 - DNA, 201 bp, Homo sapiens
ttttggcttctatttatcactcttcagttttgtatcttcctgttcaagcccttcagtcttacacggaggctccttgtattctgtgtgccccttaaatgttkattcccaaggatttgcacttaactatattcttttaaaaaatctaaagtgattttatttcaagagccttttatataggaaattcttttaaaaggtgagtgt

SEQ ID NO: 6379 - DNA, 201 bp, Homo sapiens
cacctcgtggtaaaggttatagcagcaattatagaaggtaaactgagaactttgtattgttcatgtactattagaagatggcttttgtaatttatctagtrtaaaaatctgaaatacaaccatatatttggtcagattttctatattggtggtagtcttaccagtaattgaagatcgacaggatctttttgttattttcaa

SEQ ID NO: 6380 - DNA, 201 bp, Homo sapiens
tcatgctattctcctgcctcagcctccagagtagctgggactacaggcgcccgccaccatgcccagctaatttttttttttttttttgtatttttagtaasatggagttttgccatgttagccaggatggtctcgatctcctgacctcatgatccgcccgcctcggcctcccaaagtgctgggattacaggcacgagccac

SEQ ID NO: 6381 - DNA, 201 bp, Homo sapiens
tctgcctcctgggttcatgctattctcctgcctcagcctccagagtagctgggactacaggcgcccgccaccatgcccagctaatttttttttttttttttgtatttttagtaacatggagttttgccatgttagccaggatggtctcgatctcctgacctcatgatccgcccgcctcggcctcccaaagtgctgggatta

SEQ ID NO: 6382 - DNA, 201 bp, Homo sapiens
ctctgcctcctgggttcatgctattctcctgcctcagcctccagagtagctgggactacaggcgcccgccaccatgcccagctaatttttttttttttttttgtatttttagtaacatggagttttgccatgttagccaggatggtctcgatctcctgacctcatgatccgcccgcctcggcctcccaaagtgctgggatt

SEQ ID NO: 6383 - DNA, 201 bp, Homo sapiens
tgaagataccttatttttagtatcacctttttaatcttagaaattcagagtatagggatttatcctactagttagtacattcatgtagttttaattgcctrattgtttgaaatttccctaatattatgccgctactcatccggattaaagtgttatgctttcacttatgcttccagtagatgagacctggaaaagataatt

SEQ ID NO: 6384 - DNA, 201 bp, Homo sapiens
tactacataatgacatttgcattgttgccagcagcacacagagccaaattactttatctttgctttgttagtatgtgttttcaaacttgtctttttgccartttcatagaaaaaaatgttatttcatcatagttttaattatgtttctcttgtgagtgaggttgggcatcttcatgtatttacaggtaatttactgtatcc

SEQ ID NO: 6385 - DNA, 201 bp, Homo sapiens
aaccatgacattcaattaccttattagattgtcataaagattaagtgagttaatatatgacaagcacttaaaatagtgtcacacacatagtagcaatataygttacttgctattattaatgtcattactattattatgttagtggttttgttctcttcatttctgtatcctcattgccaaaaataatgcttggagcttagt

SEQ ID NO: 6386 - DNA, 201 bp, Homo sapiens
aggcataaatggattaagttgacacataaaattaaccatgacattcaattaccttattagattgtcataaagattaagtgagttaatatatgacaagcacytaaaatagtgtcacacacatagtagcaatatacgttacttgctattattaatgtcattactattattatgttagtggttttgttctcttcatttctgtat

SEQ ID NO: 6387 - DNA, 201 bp, Homo sapiens
gaactgaaaagtgagaggcttatatgaggtagtcagtaggaaatagttgcatttaatcagtagaggttttcagattaaaatggaattgtattttcattttrtattgcagagacttgttattttatggaatttgagcacaaaagataaattagctttgaaagcaaaattagacccctaaatatagtcaggaagaatattcaa

SEQ ID NO: 6388 - DNA, 201 bp, Homo sapiens
ccttgtataacttttgactccccccaaacttagctactaatagcccactgttaactggaaactttactgataacataaacgtttgattaacacatattttktatgttatttgtattatatactgtattgttattacaaagtaagctagagaaaagaaaatgttaagaaaatcataaggaagagaaaatatatttactattc

SEQ ID NO: 6389 - DNA, 201 bp, Homo sapiens
ttctttttaatgttacaacaaggaattgtaaaattacttaagtgcttgcatcatgtttctgttggaaagggctggtctaggtgatgtgaatcagacaatayggtggaactgaaaagtgagaggcttatatgaggtagtcagtaggaaatagttgcatttaatcagtagaggttttcagattaaaatggaattgtattttca

SEQ ID NO: 6390 - DNA, 201 bp, Homo sapiens
cttctcctcgtcgaaaaagaactccttcaccatcttatcagcggacactaactccacctttacgacgctctgcctctccttatccttcacattctttgtcrtctccccagagaaagcagagtcctccaagacatcgctctccaatgcgagagaaagggagacatgatcatgaacgaacttcacagtctcatgatcgacgcc

SEQ ID NO: 6391 - DNA, 201 bp, Homo sapiens
tggaatagagaggggtaacatagagacaacatctgaagatggtcaagtattttcaccaaaaaaaggacagaaaaagaaaagcattgaaaaaaaacgtaaamaatccaaaggtgattctgatatttctgatgaagaagcagcccagcaaagtaagaagaaaagaggcccacggactccccctataacaactaaagaggaatt

SEQ ID NO: 6392 - DNA, 201 bp, Homo sapiens
ataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactt

SEQ ID NO: 6393 - DNA, 201 bp, Homo sapiens
aataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttact

SEQ ID NO: 6394 - DNA, 201 bp, Homo sapiens
gcaactgcctctatggaaacacatgtagattcgtacatggcccttcacctcgtggtaaaggttatagcagcaattatagaaggtaaactgagaactttgtrttgttcatgtactattagaagatggcttttgtaatttatctagtgtaaaaatctgaaatacaaccatatatttggtcagattttctatattggtggtagt

SEQ ID NO: 6395 - DNA, 201 bp, Homo sapiens
aatctgcccacgcatataatgttcaagaaataaatgtgcatatgagagtggaaatgaaagtaatataaacatctaaaatcatgtattacatttctgaaatwcaaaaaacttcaaacatttttcctaagacacagacatttgggagcaaaacctggtcttaattgaaataaatttaattacagtttttatacaagtggtgaa

SEQ ID NO: 6396 - DNA, 201 bp, Homo sapiens
ctctaactgtaatccattcccactattagtatttttatgcccagatgtcccttccttagcttgtgggtgatctttgtattggatcctgagccttttttttwaatttactttattgaaatataattttcaaacattgaaatgcacccattttaagtatacagtttgagtcttgacagatgtgccacctgtataactaccacc

SEQ ID NO: 6397 - DNA, 201 bp, Homo sapiens
gtgaacatgaaagggatctagaaagcacttcccgagactctctagccttggataaagagagaatggataaagatctgggatctgtgcagggatttgaagawacaaataaatccgagagaactgagagtctggaaggtgagtgctacctctgttgtctgtgatactgctttatttcttttcagatttcgtgggaaacaacta

SEQ ID NO: 6398 - DNA, 201 bp, Homo sapiens
atccacctgcctcagcctcccaaagtcctgggattacaggcatgagccaccagcaaggtattaattatttttagtgttatatttgacaggtaacagatacygatcatttttatggtgcattcttgctgcaacacatgactgttgatcttcatgtaatgaatttctctaggaagatcaggcctatgttaggtaagggcaact

SEQ ID NO: 6399 - DNA, 201 bp, Homo sapiens
tatgggtgggttgggttacctgttttcttttggtgggaaggttttttatttgtcagagtccttagattctgagtattatatgggaaggcttttattttaaraataggacatttttggtttaaagtacttttcattttttctgttttctccttgatttatgtaaatgtctatgtagataacaagactgctatttcttggtgt

SEQ ID NO: 6400 - DNA, 201 bp, Homo sapiens
ctccccagagaaagcagagtcctccaagacatcgctctccaatgcgagagaaagggagacatgatcatgaacgaacttcacagtctcatgatcgacgccaygaaaggagggaaggtgtgtactgtactttgatttttttaattgaaaaattgaacatccagctttattgttgtactaagagatggagaaagactttgctat

SEQ ID NO: 6401 - DNA, 201 bp, Homo sapiens
ttgagcacttaatatccttgtgtgtaagtgtctttcatagtatttacaatgttagtaaaagtaagacttctgctgtggtggaagataacaattatataacwctggttacttttattttcttaccacctagtaaaatatgatttggagttcttatgtaataggacatttaattgacttttataatctgaattaattttgtcc

SEQ ID NO: 6402 - DNA, 201 bp, Homo sapiens
tccttaattctaggattctttcatagtcctaaatgtcaacccatgcagcgtggactttttgtttgccttagctgatgctacctccccttttaccatagccrtgaatttacaggcattctcaaagccactttctctctagatctcagtagtatgttttgccatagtttgtgggttttctccctctaagtatttgttcacact

SEQ ID NO: 6403 - DNA, 201 bp, Homo sapiens
atgctattctcctgcctcagcctccagagtagctgggactacaggcgcccgccaccatgcccagctaatttttttttttttttttgtatttttagtaacayggagttttgccatgttagccaggatggtctcgatctcctgacctcatgatccgcccgcctcggcctcccaaagtgctgggattacaggcacgagccactg

SEQ ID NO: 6404 - DNA, 201 bp, Homo sapiens
ctcagttgtccaacgttctgtatcaggtgcttctaacccgaagtccactggtggattttaggggtctacaagtttcttgagttatgtataaaactttgccygtgtatgtgttttggtgagggagagtgcccatacccttctagaaaagttcatgattttcccttctccaaaaaaatgttagaattatgaatcattcttgaa

SEQ ID NO: 6405 - DNA, 201 bp, Homo sapiens
tcttttttttttttggagtataacatttatgcagtttacatttcctagagtgtgtcaagtaatcatcttttaattttattgctggatcatactatcaactmagaacatactaagcacatgtaaggattagaatttcagttaaaactcagtggagtattttaaccagtgtcagccaactgaggtgtgataatcaggtaaaca

SEQ ID NO: 6406 - DNA, 201 bp, Homo sapiens
gcttgatcagattgttttgacttctgtcaggcaaagaaaatactaaaatatcattcatttttctcaacctgatttttggaacataactgctgttgtccctwaaacttatgaaacataatttctgctatgaaaattttcacccaattttatttttccattttctttagcataactctttttcagttaaccagttgatggtta

SEQ ID NO: 6407 - DNA, 201 bp, Homo sapiens
tatctgatagcacatcccgaagacccagtgtatttgagaggcttggacccagcactggcagtacagcagaggtgagttgtcactagtatagtcacaggggytctcttagaattctattattgaaatgcttatttgtatcataaaggtgaacaggttgttttattgtaggaatgtttgttcagtaaattttttaaagtgtgt

SEQ ID NO: 6408 - DNA, 201 bp, Homo sapiens; identical to SEQ ID NO: 4649

SEQ ID NO: 6409 - DNA, 201 bp, Homo sapiens
tatcagagggtacattaatatattggtttctgtgctgcatgttaccaccttacagtatttaaatctggcaattttcacttgagttattctacatgtataakgaagaagaagaagaaatgttgtgtattttaagttcacaattcttagcaaatgaagtaaagaatttgtattaaagacactgaatatcctttgtatgataca

SEQ ID NO: 6410 - DNA, 201 bp, Homo sapiens
agtttcatcttttacatacaatctcttttgcttctttattagtaactcatcctattataaatatttgtcatgaataatcattcacactggtttaattactrtatttcttatattctactatgttgttgactttacgatgcaccgttaatttaataataaaagcaaaaggacctggaaaaacagtatattaaaaatacaaag

SEQ ID NO: 6411 - DNA, 201 bp, Homo sapiens
tttgaaacttaatcttttcatagaaagttttgataactatttagacaaagggttagtttcatcttttacatacaatctcttttgcttctttattagtaacwcatcctattataaatatttgtcatgaataatcattcacactggtttaattactatatttcttatattctactatgttgttgactttacgatgcaccgtta

SEQ ID NO: 6412 - DNA, 201 bp, Homo sapiens
actttccctcaattctattcatttccccaataaactgcatactagaaataccctttcttccttgtcttatctgttctgtttatagaatatttgaaacttawtcttttcatagaaagttttgataactatttagacaaagggttagtttcatcttttacatacaatctcttttgcttctttattagtaactcatcctattat

SEQ ID NO: 6413 - DNA, 201 bp, Homo sapiens
aattcaggagtcaaggtcagttagaaaaagtgtattgagatttgtgaggttatttctgtaaatacattcttataaaatgttattaatatataaatacagakttttgttgttttgtttcgttttttgttttgtttctgtgttttggttcaaaggtcaccagaaagacctacaggggatcttagagaaagaatgaagaacaag

SEQ ID NO: 6414 - DNA, 201 bp, Homo sapiens; identical to SEQ ID NO: 4657

SEQ ID NO: 6415 - DNA, 201 bp, Homo sapiens
aataaagggcaagtaatgtaaaggaacgctgctgtttttaagaaggctttaaaaaatatccttttggcatatttgaacctctaatgatagctttttgttaycttcagaaattcaaaaaccaaccaaagtaaaaagaaaggaccacgtactcctagtccaccccctcctataccagaagatatcgctctggggaaaaaatac

SEQ ID NO: 6416 - DNA, 201 bp, Homo sapiens
ttttagctgtttaagatgttctgaattcaaattttgtacaaattctataggttaaaatgcatttgccaaatcccttagcacagtatgttaatgaaaatatktatttatatgtggatgaatatgctccatatttcgaacatcgttttgcctttaataaaggcttggctagattaaacttgcttaataaagaccttttatttt

SEQ ID NO: 6417 - DNA, 201 bp, Homo sapiens
tttatggtatttaaagatgtaatatacataaagtttgtcacaaaaacagttttaacttgattggtaaagaaataatttacctagatccaaaattggttacrctgattgttttggctatagcatagcaacactataaaaactgaacattagcaattggaattttttttttttttttttagttgaatgattttttttggggta

SEQ ID NO: 6418 - DNA, 201 bp, Homo sapiens
tattacatgtgcatgtaaacattaatgagatcctttaaagtgaattaactcaaattatttctttactaaccttatgatttatattcataaaatcaaggaaytgatttgattgcccaatgactgcttgaaatagatgtgaatatttatgtgatttgtttatatcttttttatatatagtactttttggtagtcaaagaggaa

SEQ ID NO: 6419 - DNA, 201 bp, Homo sapiens
ggtggatctcaagttgattatccaactttaaacctattccaggtgtcttattactgaattgaaaatgtatttctagtatgaagtttactgtctctggaaaytgtacctcctagaatgcccatgcaattattagttttgtttcacagttgcctcctcagttctcttactgccccccgacatcccctatcttgttcttttttt

SEQ ID NO: 6420 - DNA, 201 bp, Homo sapiens
caacatttctggctctaaatctgataaaaaatgttacaaatttatagattgattttgcagcaccagcactactgctctgacaccctttttaactagacttrcaattggattttacatacttttaagtggacagaaagcacagaatatgttatttaataatttggagataacctcctattaaatatttttggtatagttatt

SEQ ID NO: 6421 - DNA, 201 bp, Homo sapiens
gctagtctctgtcacaggtgataatgtaaaaatagtttgtgtcaagaattcctttgttgtttaatcatgaaattttaaaagataattttgatacagatgcyaattattgatccgtttttatctttaaagtagaaaagtatccagaaatacagatatttatcacatatctgttagggtgcataagaagattgagtcatctca

SEQ ID NO: 6422 - DNA, 201 bp, Homo sapiens
tctcaaaagcctgttacatttgtattctttgtgtttttgtttgttttttaaatcttggggaagtgccttttgattctgtctttgggtgggttagtttgtcrtatgttcttttttttcttttttatttatttgtttatttatttatttattattttattattattatactttaagttttagggtacatgtgcacaatgtgca

SEQ ID NO: 6423 - DNA, 201 bp, Homo sapiens
ggttacgctgattgttttggctatagcatagcaacactataaaaactgaacattagcaattggaattttttttttttttttttagttgaatgatttttttkggggtagtgtatgggtagattttgtttaggagaatttaaaattcaaaccctcaacattagccaacttctttttcacgtaaacattgtacattttagttta

SEQ ID NO: 6424 - DNA, 201 bp, Homo sapiens
ttgtcacttccgttaatgtgggaagattagtgtttattgtatatgtgtgtttacttgtatatatacacgtagatacatacctggtgaaactatttcgatamttttaatgttttgctttaatactatacttttgatacattttaaaatttatctttgaaatttattagctgactcagaatttttattcaagaaatcattttg

SEQ ID NO: 6425 - DNA, 201 bp, Homo sapiens
gtgaattgaattttgactattcagataggtgtgtagtggtatctctttgtggttttactttgtatttccctattagataagctcttgagcgtcttttcatrtacttatttgccatctgtatatctttggtgagattgttcaggtcttttgcctatttttaaaaacaggttgttttcttattattcaattttaagagttcct

SEQ ID NO: 6426 - DNA, 201 bp, Homo sapiens
aaagtaattgctcacattgtgcagtactatgttgtacagaccacgtgaaagggaatgctggtctagctggcgtggtatgtttataggcgaatttcagcagmaggaagccaaaatagttttttccttttgaaagttttttaaaaattatttcatgggtcttttttttaattaatatgtgtgcattgttacaatgtatgttgg

SEQ ID NO: 6427 - DNA, 201 bp, Homo sapiens
gaaggattgtcaagtaaaggtaagattgaattacagtgtagcaccatagaagagcttttattccatcacatggaagaaatagtgccattcaacaacagaaygtgcagtgtgttttttgtttgttttgtcattggaaatgataaagtaaaaaccggttgattacctgtcagaaattgttgagaggattcctactttaagcaa

SEQ ID NO: 6428 - DNA, 201 bp, Homo sapiens
ggaactgagggaatccttgtaatcactgcatggttcgaagatgagagaaaaggaagtgtcttctcttgtgctgtggagtagttctttggggtcaaaaaatgtgttcttggcatctgatatacctaagggcattctcccacctcacccccttttaaccagaaaagaacttattgctcaaatatctaggaagttggagattag

SEQ ID NO: 6429 - DNA, 201 bp, Homo sapiens
tgaccgtacagaggtgacagaagcagagcatactgccaccgccacgactcctggtagtaccccttctcctctatcttctcttcttcctcctccaccgcctrtggctactgccactgctacaactgtgcctgcaactcttgctgccactactgctgctgccgccacctctttcagcacatctgccatcactatttccacctc

SEQ ID NO: 6430 - DNA, 201 bp, Homo sapiens
cctcttaaacgtttttttatcccagactaattttctgctcaactgggtatttgggcagcatgcattcatttactctgtgtttatgtgatttgtgtgtacatggaaaaaatttatataaaatgtgatgaggttatcagttaacattttaagaaaacagctcttcatctgagtaatcatttatgtaattaaagctaatttatt

SEQ ID NO: 6431 - DNA, 201 bp, Homo sapiens
gggcacagcagggatgtcttttctcttgatctgtgggcctcagttaatctactggaagcacgtaggctggaatcacttgaaggtttatttactcacctgtytggcagtcgatgctggctgtcagctagaggcctctgtttgtctctatgtggtctcttcccttggatagcttgggcttcctcacagcctgataactgaatt

SEQ ID NO: 6432 - DNA, 201 bp, Homo sapiens
acttactgaatttttttaaaggtttcaccagaagtggttagatcaaaattgtccccgtcaccttctctaagaaagtctagcaaatctccgaagcgaaaatmaagcccgaagtcgtcttcagctagcaagaaagataggaagacatctgcagtatcttctcccctgttggaccagcagaggtcagtagggtgataaatagta

SEQ ID NO: 6433 - DNA, 201 bp, Homo sapiens
aagaaaagaagtttaattggctcatggttctgcaggccgtacaaacatggctccagcatctgctgctggtggggcctcagaaagcttactaggaggaggtrtgctgaagtaaaagtgctaattcatttattcatccaacagttacttgattacctgttctaaagctggtattgcagcagtgggcaaaaatatttccaaaag

SEQ ID NO: 6434 - DNA, 201 bp, Homo sapiens
aaccaaaacctgggcgttagctgtgtttgtgctagtggggtattgtttcttttaggacctctcagctagcagagcaaataaatatatgcgtgtatactaastggtatatataaatatttctaatgaccatctgttatctgtattaagctaaccatgagtttttactgatttctctaactgtaatccattcccactattagt

SEQ ID NO: 6435 - DNA, 201 bp, Homo sapiens
aattaactactctttccgttgttttacctgggtatttggttatggaattttattgaatttaggaacataatcaaaccagaacattgactcctattattcaytgatgtaaagtatctcaatagagtacaaaataataactggagatagctagtattcacttaattaaattcagtgtcttcattttatctagtgaaaactact

SEQ ID NO: 6436 - DNA, 201 bp, Homo sapiens
tggccaggatggtctcgatttcttgacctgatgatccgccctcctcggcctcccaaagtgctgagcttacaggcgtgagccactgcgcctggctgacttasacatatattttaactgctcaggcctctcccccttggttggatagttgaaaattgagaactgaaagccagcttcttctttcttttatgtgttctgtattgg

SEQ ID NO: 6437 - DNA, 201 bp, Homo sapiens
atgacatataaaaatccattatatgcttttatgaaaaataactattttgcaagcaaaaaataataattgtgaggaggtggcagtgttttgcatcattttgyaaattgttttaatatctggcttaatagttgataggtagattttcttacctgcttctacattccacctgttaaccacatcacatattctgggaaactccac

SEQ ID NO: 6438 - DNA, 201 bp, Homo sapiens
aagattgatcagtgggaggggggaagggggttgacggggagcaggaaacatggtcgttagagggcaaataaaaattatctttaaaaaatttaaggtctagkggcgattgttacttggatattaagttaaaattaaatatgctacttggtttgtaatttgttgccagtgtgaccctatacacagataaaatttaagatttac

SEQ ID NO: 6439 - DNA, 201 bp, Homo sapiens
acaaaaggagagacttggatagggaaagagagagactaatttctgattctgttgaaagggacagggacagagacagagacagaacttttgagagttctcawatagagtctgtgaaacgctgtgaagcaaaactggaaggtgaacatgaaagggatctagaaagcacttcccgagactctctagccttggataaagagagaa

SEQ ID NO: 6440 - DNA, 201 bp, Homo sapiens
ctttttcagaacccccaaataacttttatccttgtgtattttatgtttccataactgccatattatgaacctgagaaaattttttaatatttatgtattcrttcatttaacaatgacatataaaaatccattatatgcttttatgaaaaataactattttgcaagcaaaaaataataattgtgaggaggtggcagtgtttt

SEQ ID NO: 6441 - DNA, 201 bp, Homo sapiens
agaattattacattttatattgataaaaatatagattttccaatttaaaatcaccatatattatttcatattttccttccttgatgcaccatcttttattkatcaaatgttgttcttagtctttggattcttttaaaagtgtgacctgaagtacctcattgaaccaaacactgtttataattttttattgctgtttcaatt

SEQ ID NO: 6442 - DNA, 201 bp, Homo sapiens
tgcagtggcgcgatctcggctcactgcaacctccacctcccgggttcaagcgattctcctgcctcagcttcccgagtagctgggattacaggcgtgcacckccacacccagctaatttttgtatttttagtagagacggggtttcaccatgttggccaggatggtctcgatctgttggccaggatggtctcaatctcttga

SEQ ID NO: 6443 - DNA, 201 bp, Homo sapiens
gttctggccaggtgcagtggctcacgcctgtaatctcaacactttgggaggccgaggtgggaggatcatgcggtcaggagattgagaccatcctggctaayatggtgagaccccgtctctactaaaaatacaaaaaattagctgggcatggtggcatgcacctgtagtcctagctactcgggaagctgaggcaggagaatt

SEQ ID NO: 6444 - DNA, 201 bp, Homo sapiens
agaaaaacatcttacttgtgattggtcttgttttttttttttttttttttccctcagcagtgataacgatttaggtcctgggaattgagtgctactttatmttcacaagccttaggtaggtagttttggcaactgtcagaaacgggggaaagtggaatagaaagaagagagtctgtttggcggcattatctctctgtaata

SEQ ID NO: 6445 - DNA, 201 bp, Homo sapiens
tcatgttatattgcagcaacaaattctgacatatgttttgttctactatattttcctcacataatagctgcactttgatgtgtatatattttggcctgaarttagaggtgtgacttacgagggaaattttttttttccttcagctcctatgttctacacctcctgctgcccctatcctttgccaccagtgttctcaggtcc

SEQ ID NO: 6446 - DNA, 201 bp, Homo sapiens
gtgatcttataagctgttctcataattgctgtccagattgtattcttgctattaaagtttaatttaactaattaaattttatttttgttttcttttgataytatcaagtatttgaataattaagagatacagttttctgatgaaaagatgtttttcacattgttataatgtgtgtaccctctaccttttggtttgacttag

SEQ ID NO: 6447 - DNA, 201 bp, Homo sapiens
tgtaaacattaatgagatcctttaaagtgaattaactcaaattatttctttactaaccttatgatttatattcataaaatcaaggaactgatttgattgcycaatgactgcttgaaatagatgtgaatatttatgtgatttgtttatatcttttttatatatagtactttttggtagtcaaagaggaacagagcattcctt

SEQ ID NO: 6448 - DNA, 201 bp, Homo sapiens
aagagagagagaaaagattaaaaactgataaaagtaaacaggtgggctctttgccacaagtctgaagtaggctctgtgccactgaaacaacaattagttgrctttttaaatgttgaagatcttggtgatttcagaatacacaaaaccagttttggcctcttcagttggaaagcactgtaacgtaattgtgttttctaacca

SEQ ID NO: 6449 - DNA, 201 bp, Homo sapiens
tatgttttaagagtaaaagtaaattatatttcttccttttgtcttctgttcaagtagaggcccatttctgttttcttgactcttcaccatttttttcatgrcaggttttattctcatataacttacaaattattttcgtcagcctctgttgtcttaccagcaatcaaatccaaattttgtcagtaatatttacagtatgac

SEQ ID NO: 6450 - DNA, 201 bp, Homo sapiens
cagttaggaaaacagaattatctttgactatataacattgctaaagaaaagattacttcattaaagaaaaatactcagatttagggtagtgggtagggggrattcaatttttaaaaaacagaagaatgagtttatctccaaagattaaaatggaaacaaatacgaggaacaggagatttttaaaacatgtcttgactgtat

SEQ ID NO: 6451 - DNA, 201 bp, Homo sapiens
tggagtagctgggattacaggcacccaccaccatgcctggctaatttttgtatttttagtagagatagggtttcaccatgttggccaggctggtctcgaaytcctgacctcaagtgatccacccctcctctgcctcccaaagtgatgggattacaccatgcccaacctaaatctactttttgttacggaaagatgctcaca

SEQ ID NO: 6452 - DNA, 201 bp, Homo sapiens
tagcctatttcatatatttactgagaaattgtcattgtactccaacataagatgagtaatcaagcttagtcacacaggtagtgaatatatatagttacccwctcagtccccaagcatgaatggatagttgtcattctaatgcatttgagcaatatataacagtgatgttcattttcttgggttttaagcagtcaagtagga

SEQ ID NO: 6453 - DNA, 201 bp, Homo sapiens
ttgctgtattaaaattaaagttatgtattgatgttcttaaggcttttacccatattgacaaataattttacaagatagatgtactagtttgcattgctacygccagagaatgagtatgtcctttatttgtacctttaccaacaattaatattataattagaaaaaatggctcctgaatacatgaaaaaatatgtgtatact

SEQ ID NO: 6454 - DNA, 201 bp, Homo sapiens
ggtttgtgttataattgtaagcccatattacttgtgttagtagttttgtctctataggtaacataatgacagtggtgtaaagtttctgttcaagaaacatrtgttgtaaagttactttatacaagatacctgccaaaggaaatggtcttactttcaaatgactttgaaagcatgtataattgcaaacagagcaggagaaga

SEQ ID NO: 6455 - DNA, 201 bp, Homo sapiens
cagcctcctaaccatttttatactctagttactaataatggttctcaactctcttagccttgacacttcctatttcatattctttgtaatgcttgcttttyatctaaaattaatgatgaacataatctgcccacgcatataatgttcaagaaataaatgtgcatatgagagtggaaatgaaagtaatataaacatctaaaa

SEQ ID NO: 6456 - DNA, 201 bp, Homo sapiens
taaacagaaatgtgtggtaatgaacaattttcaaggaagggtgtaggctcaatgcatttcttttatattatatctgtagtggaatggtagttaatgttttygtttttgtttttaatcatgtgcatatatgactatatcattggttggtacaaacattggtatatctgaatcatctgaaaaaactgccccttttttccctta

SEQ ID NO: 6457 - DNA, 201 bp, Homo sapiens
tttttatgttagaaaggaatcactattttattaaaagtataaagctttaatcaagtcacagaaaacttgatgtttaagtgagtgtagtgttctagttagcwgacttttcatttactgtcacccagaggtatttttatttgcctaaattcttttctgcatattctttctaatatattagatcacattcctgacttagtaaca

SEQ ID NO: 6458 - DNA, 201 bp, Homo sapiens
ttaatttaataataaaagcaaaaggacctggaaaaacagtatattaaaaatacaaagaaaacatttaattgagtatagcatttcttttcttttttttttttggagtataacatttatgcagtttacatttcctagagtgtgtcaagtaatcatcttttaattttattgctggatcatactatcaactcagaacatactaag

SEQ ID NO: 6459 - DNA, 201 bp, Homo sapiens
tgaatggatagttgtcattctaatgcatttgagcaatatataacagtgatgttcattttcttgggttttaagcagtcaagtaggacttcttatgtttgttrtttttttagttcttcattttatttcttttcccaaggttaagatatgatctaaagtgctagaagtatatcttgagaaggcacctcagtttgtggtcagtca

SEQ ID NO: 6460 - DNA, 201 bp, Homo sapiens
cctgttgtggggatggggggtgaggggagggagagcattaggacaagtacttaatgcatgcagggcttaaaacctagatgacaggttgataggtacatcarcctgtacctataggtacaaaccaccatggcacatgtatacctatgttacaaacctgcacattcagcacatgtatcccagaacttaaagtaaaataaataa

SEQ ID NO: 6461 - DNA, 201 bp, Homo sapiens
gtgtttgtgctagtggggtattgtttcttttaggacctctcagctagcagagcaaataaatatatgcgtgtatactaagtggtatatataaatatttctartgaccatctgttatctgtattaagctaaccatgagtttttactgatttctctaactgtaatccattcccactattagtatttttatgcccagatgtccct

SEQ ID NO: 6462 - DNA, 201 bp, Homo sapiens
tgttaatcagtttaatatcaggattttagtagtatgtcttggtggaagggtttatgtgttcaagtcccttattgatgcctatgattttaaccttcctgctmttcttcatgcagtcaaggctgcctcttttgaccacagaaaataagataggggagtaggaggagatcaaataatggagtgattagttctattaatgcctaa

SEQ ID NO: 6463 - DNA, 201 bp, Homo sapiens
ttaatgatttttggttgtcttttctaatatatacattcaatgctataaatatctctttgggtacagtgtttactgcatccaacaaattgttgtaagttatmtttttattttcatttagtttaaaatattttaaaaatttttttgcaatttcttctttgaccaatatgtttattaaaattgtgttgtttaatttctaagcat

SEQ ID NO: 6464 - DNA, 201 bp, Homo sapiens
ccacttaccgttgtatataggaaagtgattgacttttatgtgtattagccttgtattctgcaacctgaactaatctatttgtcagttcttttgcccacccrcagtcttgattgctatagctttataggaagtcttgaagttcttgaactttataggaagatcttgaaaaaagaactaattcctgaagttcttctgttagtt

SEQ ID NO: 6465 - DNA, 201 bp, Homo sapiens
tggttttaattgagcatttatgtgattctttgttcattcttttttagcatatcaattatacttctttctactttttttggtggttaccctagagtttacartgtacatttacagctaattcaggtctgctttgaaacagcactatactacttcatctataatacagataataacaaaatattcccagttctttactctggg

SEQ ID NO: 6466 - DNA, 201 bp, Homo sapiens
ttaattatgtttctcttgtgagtgaggttgggcatcttcatgtatttacaggtaatttactgtatcccctgcccattttctctgtttttttttttttttttggtctttttcttctctgttttaaaaattctgtattttagggaaaatattttacttaagatatcaagtacagataattttacttgtcacttttctggtttt

SEQ ID NO: 6467 - DNA, 201 bp, Homo sapiens
ctttaacttctgtcccatgattgctgtacccttttccctgtaggtaaccacatttattagtttttgggtaatccggctgttttaatacacacatatatatwtttaatatttacatatatatgcacacaaattagtgtatatataatcaccttttttctttttcttagataaaaggtagcattactgtatacatttttcttc

SEQ ID NO: 6468 - DNA, 201 bp, Homo sapiens
aaaatagtaaagataagataattcttgtcttttcaatcagtgattaggaagggaaatccagaatactgtattgaacccttcctagaaacatcctaaaattrttctgcttaatgagttgatgttagatgttccacttaccaacctgttggcctgattataatatgatctttatcaaaaaccagtagatatatagtatgtaaa

SEQ ID NO: 6469 - DNA, 201 bp, Homo sapiens
agatgcttaacaacatgggaatgttagctgttaggtgtatacaagttggtatttacaggtatactaagctggtgctttctttagttaagatgttctggccrggtgcagtggctcacgcctgtaatctcaacactttgggaggccgaggtgggaggatcatgcggtcaggagattgagaccatcctggctaatatggtgaga

SEQ ID NO: 6470 - DNA, 201 bp, Homo sapiens
gggtttcttgtagacagcataccattgggtcttgtttttccatccactccgagaatatctatgttttaattggtgtatttagaccattgatgtttaaagtrattgttgatgtagttgaattaatatctacaacattcgttactgttttctcttcattgccattgttctttgttcctgtttttgttctcacttgttttgtgc

SEQ ID NO: 6471 - DNA, 201 bp, Homo sapiens
aaccttctgagcatctttatcaatacagtgttaaatataagtagaaggggccgggcgcggtggctcacgcctgtaatcccagcactttgggaggccgaggygggcggatcacgaggtcaggagatcgagaccatcctggctaacacagtgaaaccccgtctctactaaaaatacaaaaaaattagccgggcgtggtggtgg

SEQ ID NO: 6472 - DNA, 201 bp, Homo sapiens
gattggtaaagaaataatttacctagatccaaaattggttacgctgattgttttggctatagcatagcaacactataaaaactgaacattagcaattggawttttttttttttttttttagttgaatgattttttttggggtagtgtatgggtagattttgtttaggagaatttaaaattcaaaccctcaacattagccaa

SEQ ID NO: 6473 - DNA, 201 bp, Homo sapiens
ccacatgacagtaaataacagagaagaaaaattggtattaacattaattctagagctgctcaaagaaaatccaggaattggttgataatgttagtgttctktgaaactaagtttatttttagagcaataggatttgaaatagcattattcttttaaaataaaatgagaggttagacctggtatcgtggatcacgcctgtaa

SEQ ID NO: 6474 - DNA, 201 bp, Homo sapiens
tcctttacttttaatctattaatatatgtgtttatatgtgggtttcttgtagacagcataccattgggtcttgtttttccatccactccgagaatatctaygttttaattggtgtatttagaccattgatgtttaaagtgattgttgatgtagttgaattaatatctacaacattcgttactgttttctcttcattgccat

SEQ ID NO: 6475 - DNA, 201 bp, Homo sapiens
ttcctttacttttaatctattaatatatgtgtttatatgtgggtttcttgtagacagcataccattgggtcttgtttttccatccactccgagaatatctrtgttttaattggtgtatttagaccattgatgtttaaagtgattgttgatgtagttgaattaatatctacaacattcgttactgttttctcttcattgcca

SEQ ID NO: 6476 - DNA, 201 bp, Homo sapiens
ctcatactcttttttgattagtgttagcagtatacctttcttcattcctttacttttaatctattaatatatgtgtttatatgtgggtttcttgtagacarcataccattgggtcttgtttttccatccactccgagaatatctatgttttaattggtgtatttagaccattgatgtttaaagtgattgttgatgtagttg

SEQ ID NO: 6477 - DNA, 201 bp, Homo sapiens
atgatgtgtctaagatgtcattgccatacccaaggtcatctagatattctcttatgttactttctaggagttttattttttttgtcttacattaagatctrtgatccattttaagttaatttttgtgaaggctgtgaggtctatgtctagattctttttatttatttatttattttttttgcatttggttgtccggttgtt

SEQ ID NO: 6478 - DNA, 201 bp, Homo sapiens
tggaaagcactgtaacgtaattgtgttttctaaccacatataattttgatggtaatgtgaagaaatgctgtactttagtaagtatattagaatagtccagrttgtgattatagccaagtcccaaaatgtcggtggtttaacacaacagaaggttatttctcacgtaaagtcaaaatgagtgtttctgattgacagatggct

SEQ ID NO: 6479 - DNA, 201 bp, Homo sapiens
tctatttttgctgctatggtggttgtattagagaactgatgtattatcttgaataaagactttgtcttgtttactgccatatccaaggtctaattatctayctatattttctgctattgcccagaaaagtgcctgacatacatagtaggttttcagtaaatatttatgaaataattgatactgatttttcttttccatttt

SEQ ID NO: 6480 - DNA, 201 bp, Homo sapiens
ctaatgctttgttggtacctggaaatggtaattggcatttgtgtattaatcttacatttaaatgatgttgctgtattttcttgatctaattagattctctwaacagatgttcctaggaacacactgatttggctcttcttttctgattattaattttctgtcagtaaccttctgagcatctttatcaatacagtgttaaat

SEQ ID NO: 6481 - DNA, 201 bp, Homo sapiens
ttacctgaaaagggtaaggtttttgacttgtctatgaactatatcttatatagaaagtataaaatctcctaagatttctaatatgttgtttcttacatttrttatcattttgtcacagtaatttttaattaattgaacttgtagtcttccttataaattcctaattggaattactagttaaaatagcaaaagataaatgga

SEQ ID NO: 6482 - DNA, 201 bp, Homo sapiens
agtaaattttttaaagtgtgttttataaaaagaagtgaaaagggtgataaggtttatgggtttttccatatttttttcctgaagtttttattatttggggrgtaatatatcacaggttagctggaattttggtagcatttgttttaattttgtcccgctagcattttttttttccagaaataaatatgaaatttacatagt

SEQ ID NO: 6483 - DNA, 201 bp, Homo sapiens
gacagctcaaagcaggggcttccaggctataggtaaattttaaatttttccagttgataattaattgagtttatctgaagacctgggatcaatagaaaggraatgtttaggttaagataaagggttgtggagaccaagttttattgtgcagaggaagttctcagggcagacttcagagggagtaggttataaaatgtttct

SEQ ID NO: 6484 - DNA, 201 bp, Homo sapiens
gctccatggtctccagtcatcagagcaactctacctggtattatcatccccattttacagataatgacactgaggctcagaaaggttgaggataagcccastttcctgtcattagtggcagccccagatccagacctaggcctcctggcacccagtccactggcagtggaattgctttcctgagaatcattctgaggctgg

SEQ ID NO: 6485 - DNA, 201 bp, Homo sapiens
tgcttgccacaggggtttggagaagggagagagcatcaaggtgtcaacgaaaagagtcagactctatgagcgaccatggcctgtgacacagccctcaggaraccctgagaacacgtgcccaaggtgatcagggcacagtttggttttatacatttttgggagacacgagacatcaatcaatacatttaagatgtacattgg

SEQ ID NO: 6486 - DNA, 201 bp, Homo sapiens
gggtgagcattccaaactggagaagttaaggtttcacttccacaggcaaagagagaggaattttagcaggattacaacattttccatacaagaccagtgcrtatgttacagtgctttgattggttatagattgctacattccaaggaagatgactttattaccccctgagaaagggtggtgatctaagtggggatctaagg

SEQ ID NO: 6487 - DNA, 201 bp, Homo sapiens; identical to SEQ ID NO: 4876

SEQ ID NO: 6488 - DNA, 201 bp, Homo sapiens
tcaaccttaaataatgagattcagaaaataagactaagtatagagtttctttgagtgcaaagtttgagaatagccacccagtaagcattgactccaaaggmatggggtgagcattccaaactggagaagttaaggtttcacttccacaggcaaagagagaggaattttagcaggattacaacattttccatacaagaccag

SEQ ID NO: 6489 - DNA, 201 bp, Homo sapiens
tcagatgtgcattttgcaaatattagctacatgaaagggcaatgtggagagtgaattagagaagacaagcgtggatgaggaaagacctggtgggggcttaragataatggggattggaagagggtggtagtggggtggaggtagggaaaaatagtggatttgagaaataagtaaggagtacaattggcagggcgcatgatg

SEQ ID NO: 6490 - DNA, 201 bp, Homo sapiens
ggaggctgaggtgggaggatggcttgagcccaggaggttgaggctgcagtgagccttgatggtgccactgccctccagcctgggcaaaaagtgagatcctrttcccctgccccccgccaaaaaaaaaaaagaaagaaagaaaagagaaaacagagactttgagaacctattatttttgcctcaggtcgtagagcctgtgtc

SEQ ID NO: 6491 - DNA, 201 bp, Homo sapiens
caaacacagctcagatcaccaggtcaagcacctaggcctggcttctcctgagacagaggactcagaagtggcctttcctccaaagcctgctcagacacagrtctgtagggccagggtgttctgcttggctgggctgcagctgctacccctcggttggggctgagtcagccagatcctccccctacttctccccaagggcca

SEQ ID NO: 6492 - DNA, 201 bp, Homo sapiens
tcccttcctctctgggcttttttctctccatctgtaaaatggagcggctccccaggaagccagtcaaggacgaagttacgcatgttctttccccaggaagrctccacttcccaagaatgcttggcaccccttgtcgtcccagcagatggcaaagaggtgagaggagcctttgtcttggaccggccccagaggctccgtcat

SEQ ID NO: 6493 - DNA, 201 bp, Homo sapiens
acaaacacagctcagatcaccaggtcaagcacctaggcctggcttctcctgagacagaggactcagaagtggcctttcctccaaagcctgctcagacacargtctgtagggccagggtgttctgcttggctgggctgcagctgctacccctcggttggggctgagtcagccagatcctccccctacttctccccaagggcc

SEQ ID NO: 6494 - DNA, 201 bp, Homo sapiens
gaattgcttgggcccagaagacggagatcacaccactgcactccagcttgggcaacagagtgggaccctgtctcaaaatgactagatcgcatacaagttgktgtaaatgctgagccaggtaagcaaacatcttgcttgccacaggggtttggagaagggagagagcatcaaggtgtcaacgaaaagagtcagactctatga

SEQ ID NO: 6495 - DNA, 201 bp, Homo sapiens
acaactagctgacaaagcttcctggccttccctttaacacagttctgctgccatagttccatctataaaatgggaatggagggaaataggggaactgggakagagaacacagccttgccaagcagcaatgttagcctgatccttcctccacctagctcgccatctcgcccttggaaaatggctcctggaggattaggcagc

SEQ ID NO: 6496 - DNA, 201 bp, Homo sapiens
atggtgaaaccttgtctctactaaaaaaatacaaaaattagccaggcatggtggcgcacacctgtaatcccagctactcaggagactgaggcaggggaatygcttgggcccagaagacggagatcacaccactgcactccagcttgggcaacagagtgggaccctgtctcaaaatgactagatcgcatacaagttgttgta

SEQ ID NO: 6497 - DNA, 201 bp, Homo sapiens
attctgagcaagggcctgggcccaggagccagccagggatgagtgccatcatggctctccactcagactgtgcctggcccctgcacttacaacttcctgcygctctgtggccttgccctgtaatcactcagtgcccttagctagcctgactaagtcccagatcccctacagcttccttcggtgtggtatcttttgccacat

SEQ ID NO: 6498 - DNA, 201 bp, Homo sapiens
tcctgctgatagcagtcagcttgaggaggatgaaggaaggcagcctcagacaggaattaaggcaatgcccaggcgggcctgggcactgtattctgagcaarggcctgggcccaggagccagccagggatgagtgccatcatggctctccactcagactgtgcctggcccctgcacttacaacttcctgccgctctgtggcc

SEQ ID NO: 6499 - DNA, 201 bp, Homo sapiens
ctctacaaggcaggtcattttgcttagggaaaagggtcttaaaggaagtagggagtgaggaccccaaggattggatctgggccgcaaccatgatcaccagyctgtcacccctttcccatcgaggccaagtgagtgtagttcaacaaagacatctcgagtcccactctgtgtccttcatcgtgccagatgcaggtttccagt

SEQ ID NO: 6500 - DNA, 201 bp, Homo sapiens
cttctgattcttctctctgcactccagagctgggtcagggaggacctgctctacaaggcaggtcattttgcttagggaaaagggtcttaaaggaagtaggragtgaggaccccaaggattggatctgggccgcaaccatgatcaccagcctgtcacccctttcccatcgaggccaagtgagtgtagttcaacaaagacatc

SEQ ID NO: 6501 - DNA, 201 bp, Homo sapiens
aatgattaagcagacaagtgatactgatgaagctgagatgccatgcctgggagagccatacatatctagtagatttaccaggttagaggacttgactccgtttttttttttttttttccagtagagatagggtttcgctatgtcacccaggctggtcccgaactcctgagctcaagcctggagttcagtgcctgcctcggc

SEQ ID NO: 6502 - DNA, 201 bp, Homo sapiens
gaagatgactttattaccccctgagaaagggtggtgatctaagtggggatctaagggagtcttatctctggtgccatttggtcttcctaagtaattacagaaaaaaaaaaaaataggtggaagttgcagctgcatgccccatgactcaggctgcagagaccaattcctgtcaaggctcagaataacttaaagttccaagag

SEQ ID NO: 6503 - DNA, 201 bp, Homo sapiens
ttagggcagcttctccaactttaacatgcatccaagtcacctgggaatgttgttaaaatcaggagatctggggtggggcctaggactctgcatttcttacwgattcccaggtgagctgatgctggtggttaagggtagcaaatctctaaagcacgaagccctcacaaatctttgccatttcccaaacactccgctccatgg

SEQ ID NO: 6504 - DNA, 201 bp, Homo sapiens
gtggcactgacacaggacttacttgcagtctcctgaaggtgcacctgcagctgcatggcttcagtgtcttcattgatgtggagaagctggaagcaggcaasttcgaggacaaactcatccagagtgtcatgggtgcccgcaactttgtgttggtgctatcacctggagcactggacaagtgcatgcaagaccatgactgca

SEQ ID NO: 6505 - DNA, 201 bp, Homo sapiens
caggggcgtgggcgtggctggggacggcttgggggtggggctgcgcaggaggctggaggagccccgcgggacccagaggcggggcgtcggcccggggaccrctgctcctccggggcgtggctgcaggaggctggaggagccccgcgggacccagaggcggggcgtcggcccggggaccgctgctcctccggggcgtggctg

SEQ ID NO: 6506 - DNA, 201 bp, Homo sapiens
caggccggggatgtcccccgcggccccgcgcccatggtcctgacgctgcttctctccgcctacaagctgtgtcgcttcttcgccatgtcgggcccacggcsgggcgccgagcggctggcggtgcctgggccagatgggggcggtggcacgggcccatggtgggctgcgggtggcccgggcccgcgaaagtgtcgccggggg

SEQ ID NO: 6507 - DNA, 201 bp, Homo sapiens
ttctaaaacccaaatatggccaggccactcccctccctgagagttttcagtggcttctctttgacatcaagataaactacaaatgccttgaggtgcctcaraaggtccccaggtccgatctcttttcacactctccccttgaatcttctgcctcagccatggaagtgtgggcagctccccaagtgcaccagctctccaaca

SEQ ID NO: 6508 - DNA, 201 bp, Homo sapiens
ccagaggtcagcccgctcacccgggaccccgccccagccccagccccagccacggccctggaatggtgaggggagacacggggtggagccttccagcctcrccgtggattgattgagcacaaacgtgggtcacactgggctctgaggatgtaaagatgaatacgttgcactttacctcaagaagttcccagtctgaggtgg

SEQ ID NO: 6509 - DNA, 201 bp, Homo sapiens
cggtgggaggaaggaggctattaaacaggcaagcggccccggcaggaagctacccaggtctccagtgggagcacagaggaagcccagcccaccccatccayccaggtctagatttcagagaggacaggatgcctgaccatgtcttgagaggtgcactggcggggaggggtggcaacaggaagggcagcccaggcagaggca

SEQ ID NO: 6510 - DNA, 201 bp, Homo sapiens
ctggggtggggcctaggactctgcatttcttacagattcccaggtgagctgatgctggtggttaagggtagcaaatctctaaagcacgaagccctcacaartctttgccatttcccaaacactccgctccatggtctccagtcatcagagcaactctacctggtattatcatccccattttacagataatgacactgaggc

SEQ ID NO: 6511 - DNA, 201 bp, Homo sapiens
acccaggctccaggccgtgggggctgctgaaggctctttccccgcaagggccaggtgttgacaccttaaagctggctgcgcccccagccccactcttggcygtgctggccaggtgactcctagttcttggccacatcatcagaaagtcaaaggtctcactccaggtttggggctccttccttccactcccctccctgccag

SEQ ID NO: 6512 - DNA, 201 bp, Homo sapiens
tgtgaggggaggtgatggggtagggctggattcggttgacaccagagatgattgtatctcttcacaactccacatccagtgatgtcatgttggtagcttgwcatcagccatggtgggagtatttacaccaaggaaattggcaaccactacaaatcaaagttttgttagtttggttgattggctggttgggttttcttcccc

SEQ ID NO: 6513 - DNA, 201 bp, Homo sapiens
cttctccccaagggccaagaactgctcagggacattaaaggtcaaaagtccagccacactcattcatcctttccccaggcccatgaagagaggcatctcaytgtagaatgtatgaggaagtgggaagtatctcagagaatcagctaagtttcctaacttgtccatccaaatgtgatcaccacgattcaacaatttggggca

SEQ ID NO: 6514 - DNA, 201 bp, Homo sapiens
tgtctgagtatctccaggggatgatttctggctctttgtctccaatcagtcccactccctcctgaggtccccaagggcagtattcagagaggtttcctgcrttttatttctatttggtataccctccactgttgtccactgccctgtgtggccttctggttgacctctgcccgatcttctgtctctctgagggaatcagag

SEQ ID NO: 6515 - DNA, 201 bp, Homo sapiens
cacctcacctcccaagtagctgggaccacaggtgcgcaacaccacacccagctaatttttttattttttgtggagacagggtttcactatgttgcccaggytgttctcaaactcctggcctcaagcaatcttcccaacttagcctcccaaagtgttgagattacgggcgtgggccaccgcacccagcgcaagatttcattt

SEQ ID NO: 6516 - DNA, 201 bp, Homo sapiens
tggccttgccctgtaatcactcagtgcccttagctagcctgactaagtcccagatcccctacagcttccttcggtgtggtatcttttgccacatccagggygagggttgaggcaaaccagccctccctctgacttccttgtcactgcagccagctttgctgcacttgctggtgcacaggagcctcctgtttgggcctgggt

SEQ ID NO: 6517 - DNA, 201 bp, Homo sapiens
ctctatattgattctatgcaatgagtgttcagtttttaaaatcaaccttaaagaactcttgaaagaataaaaagaggagtaagtgtccagtttgagggccrggcaccgtggctcatgcctgtaattctaggactttgggaggccaaggcaggcggatcgctcaagtccaggagtttgagaccaacctgggcaacatggtga

SEQ ID NO: 6518 - DNA, 201 bp, Homo sapiens
ggtgggggtggttctgcattcccttctcctgctgatagcagtcagcttgaggaggatgaaggaaggcagcctcagacaggaattaaggcaatgcccaggcrggcctgggcactgtattctgagcaagggcctgggcccaggagccagccagggatgagtgccatcatggctctccactcagactgtgcctggcccctgcac

SEQ ID NO: 6519 - DNA, 201 bp, Homo sapiens
tggggagggtccctgctcagttctggagacactggagttggggtgggggtggttctgcattcccttctcctgctgatagcagtcagcttgaggaggatgamggaaggcagcctcagacaggaattaaggcaatgcccaggcgggcctgggcactgtattctgagcaagggcctgggcccaggagccagccagggatgagtg

SEQ ID NO: 6520 - DNA, 201 bp, Homo sapiens
acgggaggttagaactcccccaggccctgccattgggttgtctgtctccgtcatggggagggtccctgctcagttctggagacactggagttggggtgggkgtggttctgcattcccttctcctgctgatagcagtcagcttgaggaggatgaaggaaggcagcctcagacaggaattaaggcaatgcccaggcgggcctg

SEQ ID NO: 6521 - DNA, 201 bp, Homo sapiens
agtggggaaggggaagaaagtgacttctgcaggacatatggagtttgagatgcctgagagatgcccagctggggagcttcagtgggtagtgtagccttttragtctggagtcaagatggctgttagagacagaggcttgcggcttgggacaggacatcagtgtgtcagccagataacccccatcggagtcccaaggggtcc

SEQ ID NO: 6522 - DNA, 201 bp, Homo sapiens
ctctctgcctcagcctcccaagtagctgggactacaagcacgcaccacatcgcccagctgggctttgtttttaaaatgttacaggttgaagattctccctrcaatatcactctctcttctttgcatttttttgtggaggcttggaggttggtgatagctggtgcacagagatgtggtgcataccccatgacccaccttgtc

SEQ ID NO: 6523 - DNA, 201 bp, Homo sapiens
gttgaagaacatttcaggtagcgatagctattgttttaattttcatttctctgattactaatgagttagagcatctctttatctggtttttcaaattttgkatttcctcttgtcaattgcctgtttatgtcctttgcccattttcttttgaatttgttgcctttttcttcttgatttgaatatttgctgatatattctaca

SEQ ID NO: 6524 - DNA, 201 bp, Homo sapiens
cgatctggttcactcattgttttcttgtctatgtcttcctccatcgccctgaggataagctctggccagtctctgttaaacctcagcccctagtgcagtgsctggcacaggggacgtcctcaggaagcatctgttgaatgaatgaatagatatgccccggtcatgggccatggagtgaggaaaaggcaaggctaagagtgg

SEQ ID NO: 6525 - DNA, 201 bp, Homo sapiens
agtggtcagggacaaaggagagtgggaatggcctttgaaataaaataaaatgatttaggtgaagaaactctaggaaagggtaattttctccatttagatcyttttttttttttttttttttttttttttgagacggagtctcgctctgttgcccaggctggagtgcagtggtgccatcttggctcactgcaagctccgcct

SEQ ID NO: 6526 - DNA, 201 bp, Homo sapiens
gaagactgcggcatccacctgggcgtgcaccgcgcccgcatcctcacggcggccagaggtcagcccgctcacccgggaccccgccccagccccagccccarccacggccctggaatggtgaggggagacacggggtggagccttccagcctcgccgtggattgattgagcacaaacgtgggtcacactgggctctgaggat

SEQ ID NO: 6527 - DNA, 201 bp, Homo sapiens
tgaagtgtcacctctctcaggacctctcctctggcctgtggggttataagtgatggatagcagaaagggagaactgactcctgtcccaaatagctcctctsccacctgtcctgcagtgggcctgtgtgggttatgattctagatcctagacagaggctgggtcagctgtggatggggtggtgccttggtctctcttgacta

SEQ ID NO: 6528 - DNA, 201 bp, Homo sapiens
tgacgtgtgcctgtaatcccagctactctggaggctgaggcaggggaattgtttgaaccagggaggtggaggttgcagtgagccgagatcgtgccgctgcmctccagcctgggcaagagtgagactccatctaaaaaaaaaaaaaaaaaaaatcacgaaagccattgcacataaattcaaaaaagtggaaaagcacacaaa

SEQ ID NO: 6529 - DNA, 201 bp, Homo sapiens
gtgaccgggagtagtcacttaacctatgtctccccttcctcaccagtaaatcctgctacatcatgtactgtgacaaggattcagtaaggtcatatgtggayagtagctggcacagaggggctactaaacaaatggctgctattaaatccacattaaaagtacatgtgatctgacagaacccagcacataaaagaaaaaaaa

SEQ ID NO: 6530 - DNA, 201 bp, Homo sapiens
gcctgtaatcccagcactttgggaggcccaggcgggtggatcacctgaggtcaggggttcgagaccagcctggccaacatggtgaaaccctgtctctactaaaaaaaaaaaaaaaatacaaaaattagctgggcatggtggcgggcatctgtaatcccagctactggggagactgaggtggaagaatcgcacagaacccgg

SEQ ID NO: 6531 - DNA, 201 bp, Homo sapiens
gtaaggattccaggaatgaagctgccatttctggttgggaggagaagaggaaacttttaagagaaagggctccattatgagcatgggttcagggccctgcrttacccaatcagaacagccgggatgagcaggaggccagctcccaggaggaaggggaaccccttcataaagttcagagtggctgggtagagtgagttgaag

SEQ ID NO: 6532 - DNA, 201 bp, Homo sapiens
gctgaggtgggaggatggcttgagcccaggaggcggaggtcacaatgagctgagatcatgccactgctttccagcctcagtgacagagccagaccttgtcaaaaaaaaaaaaaaaaaaaaaaaaacaattccatcagtgtgcctacccctttttgccacttccctcttgctttcttcttctcaggatgctattgcacccat

SEQ ID NO: 6533 - DNA, 201 bp, Homo sapiens
tcccagcactttgggaggcccaggcgggcagattgcctgaggtcaggagttcgagaccactctggccaacatggtgaaaccccgtctctactaaaaatacaaaaaattagccgggcttgatgacgtgtgcctgtaatcccagctactctggaggctgaggcaggggaattgtttgaaccagggaggtggaggttgcagtga

SEQ ID NO: 6534 - DNA, 201 bp, Homo sapiens
aggctgagacagaaggattacttgagcccaggagtttgattgagaccagcctgggcagcatagtgagagccctgtctcaattttttaaaattaaattaaamattttttaaaagttcttctcaaccagaccccctctctggagataaaccactataacaagtttcttgtatatccttccagagagagtctctgcatatacag

SEQ ID NO: 6535 - DNA, 201 bp, Homo sapiens
ggtgaaactctgtccctactaaaaatacaaaaattagctgggcatggtggcaggtgcctgtaatcccagctactcgggaggctgaggcagaagaatcacakgaacctgggaggcagaggttacagtgagctggaatcgcaccactgcactccagcctgggctacaaagtgaggctccatctcaaaaaagaaaaagaaaaag

SEQ ID NO: 6536 - DNA, 201 bp, Homo sapiens
aggaaggaggctattaaacaggcaagcggccccggcaggaagctacccaggtctccagtgggagcacagaggaagcccagcccaccccatccacccaggtytagatttcagagaggacaggatgcctgaccatgtcttgagaggtgcactggcggggaggggtggcaacaggaagggcagcccaggcagaggcagcggcct

SEQ ID NO: 6537 - DNA, 201 bp, Homo sapiens
ggcgtgatcttggctcactgcaagctccacctcccgggttcacaccattctcctccctcagcctcccgagtagctgggactacaggtgcccgccaccacgsctggctaatttttttgtatttttagtagagacagggtttcaccgtgttagccaggatgtgagcctcagttttcttttctgcaaaatggggtaacttacct

SEQ ID NO: 6538 - DNA, 201 bp, Homo sapiens
cccccatagcaccccccgggcccccagtggggaatcatctctttagcatacaaagacactcatcactcaagagattccaagggttttagcagctctgtgcyaggaactctgggcaaaggaaaaatatttattttttattacactacaagggttaaggtagacatcaaggtggacatcaggactggtgtcctgccctgggcc

SEQ ID NO: 6539 - DNA, 201 bp, Homo sapiens
gaggtggggctgaaagttccaatcctctagtcatgccctggtctccctggtgaccagccctcttcctgaaactatctaggctacccccatagcaccccccrggcccccagtggggaatcatctctttagcatacaaagacactcatcactcaagagattccaagggttttagcagctctgtgccaggaactctgggcaaag

SEQ ID NO: 6540 - DNA, 201 bp, Homo sapiens
ggacatgctcttcagtacgtggtctaggtagcccctcagagtagggccctgcagtggaagaagatacagagtttagaaaaaacatggaaacttggtttctrtactgttcagggaccataggaagtctgcatacaaacaacacagttcccatctcattcactgagactctgggctgagatggtgaccaagttttaaacgtca

SEQ ID NO: 6541 - DNA, 201 bp, Homo sapiens
caatgaggaatataaacggatcacccgcaacgtcacttgtcaggtaaggacatgctcttcagtacgtggtctaggtagcccctcagagtagggccctgcastggaagaagatacagagtttagaaaaaacatggaaacttggtttctatactgttcagggaccataggaagtctgcatacaaacaacacagttcccatctc

SEQ ID NO: 6542 - DNA, 201 bp, Homo sapiens
taatcaccagctttctccatacatttttaatgcagacctgtaattgagttcagaagcctccaagaaaacagaaaggatcccctttctccagtttgtgctgraagaggagctgatcagagacatcaaataagagaaagatgggttgctagaggatggtagaactggaagcaaggcagctacctttttgcaaaaggaaatggt

SEQ ID NO: 6543 - DNA, 201 bp, Homo sapiens
aactagttgcccggctggagaagattaagatacagctggccaatgaggaatataaacggatcacccgcaacgtcacttgtcaggtaaggacatgctcttcrgtacgtggtctaggtagcccctcagagtagggccctgcagtggaagaagatacagagtttagaaaaaacatggaaacttggtttctatactgttcaggga

SEQ ID NO: 6544 - DNA, 201 bp, Homo sapiens
ctagagaatgttgaactaaaggtgccctctctggctcctccccaaagtgagatcattgaaggctctggtcatcaccatcttcaatttcattgtcacggtgrttgctgccttcgtctgcacttaccttggaagccaatatatcttcacagaaatggcctcggtgagtaggcactgggcagggcagggtgcccctggtggggg

SEQ ID NO: 6545 - DNA, 201 bp, Homo sapiens
caatttcattgtcacggtggttgctgccttcgtctgcacttaccttggaagccaatatatcttcacagaaatggcctcggtgagtaggcactgggcagggcagggtgcccctggtgggggtgttagtgggtaagggaggacgtatgtgaaagtgccttgcacaggttaggtattgaacagatatttatgccattaataagg

SEQ ID NO: 6546 - DNA, 201 bp, Homo sapiens
taacccttcaacctcagctcgtggatcattgtgtttgtgaaaccttttcttctcagattccaaactatacctccatgagctcctagaaggcagtgaaatcyatctcccagaggttgtgaagcctccacgggtatgtaagggatatgtttgtgagagtggttattgactgagttgggcttatccatgatacactgaacttat

SEQ ID NO: 6547 - DNA, 201 bp, Homo sapiens
aagtaggtggcattttacagtgtttccagtaacctgagctatataaaatttgtgttaaaaagctacactgggccaggtgaggtggctcacacctgtaatcstagcattttgggaggctgaggcaggcggatcacttgaggttgggagtttaagaccagcatggccaatatagcgaaaccccatctttactaaaaatacaaa

SEQ ID NO: 6548 - DNA, 201 bp, Homo sapiens
tatataaaatttgtgttaaaaagctacactgggccaggtgaggtggctcacacctgtaatcgtagcattttgggaggctgaggcaggcggatcacttgagkttgggagtttaagaccagcatggccaatatagcgaaaccccatctttactaaaaatacaaaaaaattagccaggcgtggtggtacatgcctgtaatccca

SEQ ID NO: 6549 - DNA, 201 bp, Homo sapiens
ctgggccaggtgaggtggctcacacctgtaatcgtagcattttgggaggctgaggcaggcggatcacttgaggttgggagtttaagaccagcatggccaayatagcgaaaccccatctttactaaaaatacaaaaaaattagccaggcgtggtggtacatgcctgtaatcccagcactttgggagaccaaggtgggaggat

SEQ ID NO: 6550 - DNA, 201 bp, Homo sapiens
tgggccaggtgaggtggctcacacctgtaatcgtagcattttgggaggctgaggcaggcggatcacttgaggttgggagtttaagaccagcatggccaatwtagcgaaaccccatctttactaaaaatacaaaaaaattagccaggcgtggtggtacatgcctgtaatcccagcactttgggagaccaaggtgggaggatg

SEQ ID NO: 6551 - DNA, 201 bp, Homo sapiens
ccagcatggccaatatagcgaaaccccatctttactaaaaatacaaaaaaattagccaggcgtggtggtacatgcctgtaatcccagcactttgggagacyaaggtgggaggatgcttgagttcaggagtttgagaccagcctgggcaacatggcgaaagcccatctctacaaaaaaacgcagaaattagctgacatggta

SEQ ID NO: 6552 - DNA, 201 bp, Homo sapiens
cccagcactttgggagaccaaggtgggaggatgcttgagttcaggagtttgagaccagcctgggcaacatggcgaaagcccatctctacaaaaaaacgcaraaattagctgacatggtagcgcacgcctgtagtcccagctactcaggaggctaaggtgggaggatcacttgagcctgggaggcagaggttgcagtaagct

SEQ ID NO: 6553 - DNA, 201 bp, Homo sapiens
actttaggaatcagcttagcatagtgagcttgtaggaatccggatttctttccacctcaaaagcaagagtggtgaaatctgatactttgttttgtttgttkgtttttttaatataggatggcaaaagctgtgttgaaagatctggcctgagagtagcatgtgagttccagtcctagctctgtcactaatcctttgaaggag

SEQ ID NO: 6554 - DNA, 201 bp, Homo sapiens
gtggacacttcctctacaatgtttgccagtttctgttagttgggagaagtgtcagctgtgaaaagaaaaagtaggtggcattttacagtgtttccagtaamctgagctatataaaatttgtgttaaaaagctacactgggccaggtgaggtggctcacacctgtaatcgtagcattttgggaggctgaggcaggcggatca

SEQ ID NO: 6555 - DNA, 201 bp, Homo sapiens
ggtctaggtagcccctcagagtagggccctgcagtggaagaagatacagagtttagaaaaaacatggaaacttggtttctatactgttcagggaccatagraagtctgcatacaaacaacacagttcccatctcattcactgagactctgggctgagatggtgaccaagttttaaacgtcatagaagtgggagttagccgg

SEQ ID NO: 6556 - DNA, 201 bp, Homo sapiens
aacactgctgggactagggtttttccatcaggagcaaatggaatccaggccttcccagaagtagaccatactgccttgaacttgtccatatgtacaaactratcaccagctttctccatacatttttaatgcagacctgtaattgagttcagaagcctccaagaaaacagaaaggatcccctttctccagtttgtgctgga

SEQ ID NO: 6557 - DNA, 201 bp, Homo sapiens
gaacagatatttatgccattaataaggggagcattagagctttccagcagtcacgggaggttaggtaataaccccaggagaagccacattctcttttcttyccctcccccaacttagagggtggttggggggctctccatcctcattaaagttgctggggtacagagctggttgttggcctgcatcccttaagcctggttc

SEQ ID NO: 6558 - DNA, 201 bp, Homo sapiens
ttctgaatcatcttctttttctttttcccaggatacaagacatggtgggactctcagcgacctgggaaagcaaggtgaggtactaggagatcaggcttctraaaccttttcctgagatgggtcatgacactcaggcttgttgtttgactgaaacccagttggtgggggagccatgagataagagcacctcctagagaatgt

SEQ ID NO: 6559 - DNA, 201 bp, Homo sapiens
aatctttgggatctgggggagccagatattgtcctccccatcagctgtttggaaaattgagatcaaaaaaaaaaaaaacagtttcaaagcactggagttaygactagtatgtgggtctcctgatacctttagcagtgctttacccctggaaccaatgattgtgatgtgctttctaacaagctgggaatatcattcttctca

SEQ ID NO: 6560 - DNA, 201 bp, Homo sapiens
ccctctctggctcctccccaaagtgagatcattgaaggctctggtcatcaccatcttcaatttcattgtcacggtggttgctgccttcgtctgcacttacsttggaagccaatatatcttcacagaaatggcctcggtgagtaggcactgggcagggcagggtgcccctggtgggggtgttagtgggtaagggaggacgta

SEQ ID NO: 6561 - DNA, 201 bp, Homo sapiens
atttatgccattaataaggggagcattagagctttccagcagtcacgggaggttaggtaataaccccaggagaagccacattctcttttcttcccctcccscaacttagagggtggttggggggctctccatcctcattaaagttgctggggtacagagctggttgttggcctgcatcccttaagcctggttctccccatc

SEQ ID NO: 6562 - DNA, 201 bp, Homo sapiens; identical to SEQ ID NO: 5372

SEQ ID NO: 6563 - DNA, 201 bp, Homo sapiens
gagtccctatgctgaccccaatacttgcagaggtgagagaatgctctttggttgtgctacaagtgcccaaggcccaacagtccttttctctacagcttctsctctccttgcaggtgattctggcggccccttgatagttcacaagagaagtcgtttcattcaagtgagtcctccctttcctatctggggagatgccaagtg

SEQ ID NO: 6564 - DNA, 201 bp, Homo sapiens
ggccagaggcaggaagctgcccacaaagaggtggtacctactctcctacttcaggaggggagaagcgggacctggagatagaagtagtcctatttcacccyaactacaacattaatgggaaaaaagaagcaggaattcctgaattttatgactatgacgttgccctgatcaagctcaagaataagctgaaatatggccaga

SEQ ID NO: 6565 - DNA, 201 bp, Homo sapiens
taccctggaaacccatgatcccccgtctctttggtcactgtatccctgacactcccagacatttgacctcatttctgactctcccagactccttcatgtaygacacccctcaagaggtggccgaagctttcctgtcttccctgacagagaccatagaaggagtcgatgctgaggatgggcacggcccaggtttgaagacag

SEQ ID NO: 6566 - DNA, 201 bp, Homo sapiens
taacactatacccatggttggggccctgaatgtgactcatagctggctgttcatctctcctgtgacccttcataaggaattcttcctaagccctgtgatcractatctctaacccttcctcaacttgctcaccctgccatgtgtatccctgcctttagccagtttatcttccttatctcctaccctcatggtcctgtctct

SEQ ID NO: 6567 - DNA, 201 bp, Homo sapiens
cccagactccttcatgtacgacacccctcaagaggtggccgaagctttcctgtcttccctgacagagaccatagaaggagtcgatgctgaggatgggcacrgcccaggtttgaagacagagaagggaggcagggcagggaactgggggaaaatggagaagggacagaactgttaatgctggagcctgagccactctcctgg

SEQ ID NO: 6568 - DNA, 201 bp, Homo sapiens
cattcctccttctctacctcagtgtcactattcttgtttcctggcactgttcacttaaccttagaatcacagagctctgagcacttcagagatctttctayagtcctacatttgacacgtggaaacagaagccaaaggaggtcaagggacagcaagttagcaacaagggtgggcttgaaaacagccaggcctctgacagct

SEQ ID NO: 6569 - DNA, 201 bp, Homo sapiens
aagagacaagtggggcatgagagggaggtgcaataggaagagatgatgcctggcccagaacctagctctagaagggcttaggggacatctactgagtgacraaggcaatggggagatgacagtggtgggagcagctgaagtgacgcagtctattcgtccagaggaagagctgctccctgcacaggatatcaaagctctgtt

SEQ ID NO: 6570 - DNA, 201 bp, Homo sapiens
gcagagcctgcctcaccttaggaccgcatgtcttgcctgcgtgtgtcaagaacgaggctgagctgggtccctagtctgattcctttaggtcagctaagacrcaagcaggaacagccatgcttccaggattaggaattctactgaatgatccatggcaccccactgcctctgcaggttggtgtaatcagctggggagtagtg

SEQ ID NO: 6571 - DNA, 201 bp, Homo sapiens
actatacccatggttggggccctgaatgtgactcatagctggctgttcatctctcctgtgacccttcataaggaattcttcctaagccctgtgatcaactrtctctaacccttcctcaacttgctcaccctgccatgtgtatccctgcctttagccagtttatcttccttatctcctaccctcatggtcctgtctcttctg

SEQ ID NO: 6572 - DNA, 201 bp, Homo sapiens
aaggaattcttcctaagccctgtgatcaactatctctaacccttcctcaacttgctcaccctgccatgtgtatccctgcctttagccagtttatcttcctwatctcctaccctcatggtcctgtctcttctgcaggattgcacaacatgggcggggacccaattactgtcattgatgagatccgggacttgctatacattg

SEQ ID NO: 6573 - DNA, 201 bp, Homo sapiens
agaggtggtacctactctcctacttcaggaggggagaagcgggacctggagatagaagtagtcctatttcaccccaactacaacattaatgggaaaaaagmagcaggaattcctgaattttatgactatgacgttgccctgatcaagctcaagaataagctgaaatatggccagactatcaggtgagagcgtccagatccc

SEQ ID NO: 6574 - DNA, 201 bp, Homo sapiens; identical to SEQ ID NO: 5378

SEQ ID NO: 6575 - DNA, 201 bp, Homo sapiens
aggaaacaaatacccgtggtctttccctttctccttttgggcctttgctccccatagactcctacccaaaaggctgctgccatttgggaatgaagtgttcmgagttttcagcacattctccttctctgccagatgaaagccagtctctgagtctctgtggcatggtttgggaacacaggaagggtaccgattaccacaagc

SEQ ID NO: 6576 - DNA, 201 bp, Homo sapiens
tgggacttctgcagtttctgtttccttgactggcagctcagcggggccctcccgcttggatgttccgggaaagtgatgtgggtaggacaggcggggcgagscgcaggtgccagaacacagattgtataaaaggctgggggctggtggggagcaggggaagggaatgtgaccaggtctaggtctggagtttcagcttggaca

SEQ ID NO: 6577 - DNA, 201 bp, Homo sapiens
atcaatgctttggcttccaagaaagacaatgagcaacatgtgttcaaagtcaaggatatggaaaacctggaagatgttttctaccaaatgatcggtagggmgatacaagggaataaagaacacaactctcctcaggttcccctgaagtaattcattcttcctctacacctgaagctctagttgcctggaaagccttcttca

SEQ ID NO: 6578 - DNA, 201 bp, Homo sapiens
cctcagatgtctatgtgtttggggtcgggcctttggtgaaccaagtgaacatcaatgctttggcttccaagaaagacaatgagcaacatgtgttcaaagtyaaggatatggaaaacctggaagatgttttctaccaaatgatcggtagggagatacaagggaataaagaacacaactctcctcaggttcccctgaagtaat

SEQ ID NO: 6579 - DNA, 201 bp, Homo sapiens
actgaatgatccatggcaccccactgcctctgcaggttggtgtaatcagctggggagtagtggatgtctgcaaaaaccagaagcggcaaaagcaggtaccygctcacgcccgagactttcacatcaacctctttcaagtgctgccctggctgaaggagaaactccaagatgaggatttgggttttctataaggggtttcct

SEQ ID NO: 6580 - DNA, 201 bp, Homo sapiens
aaatctccaggtcctattctgtcctccttcccttttacttgaagcagtttcttgactggtaattcctccatgaacctcagcccttgagcctcttactgagrgcctccctgtcccagcaaagtcgctgaaatctcccaatcacagtattctattttcaatgccatggcgccttgttctcctcacccacaggtggcaagttat

SEQ ID NO: 6581 - DNA, 201 bp, Homo sapiens
agggaatggtgggaggttcactttggggtcaggaggttcagggtggagggggtcatgagactaccttgagggcgacagggaggaccactttgtagtcaaargttgaacagcaggatcgttgggcaatggaggttagtgggaacctgttgggggctggaagggccactttgtggtcaaagggaagtccgtgtaatgatgatt

SEQ ID NO: 6582 - DNA, 201 bp, Homo sapiens
acaaagaggtggtacctactctcctacttcaggaggggagaagcgggacctggagatagaagtagtcctatttcaccccaactacaacattaatgggaaaraagaagcaggaattcctgaattttatgactatgacgttgccctgatcaagctcaagaataagctgaaatatggccagactatcaggtgagagcgtccaga

SEQ ID NO: 6583 - DNA, 201 bp, Homo sapiens; identical to SEQ ID NO: 5369

SEQ ID NO: 6584 - DNA, 201 bp, Homo sapiens
tagctggctgttcatctctcctgtgacccttcataaggaattcttcctaagccctgtgatcaactatctctaacccttcctcaacttgctcaccctgccaygtgtatccctgcctttagccagtttatcttccttatctcctaccctcatggtcctgtctcttctgcaggattgcacaacatgggcggggacccaattact

SEQ ID NO: 6585 - DNA, 201 bp, Homo sapiens
cttccaggcagccctggaagtcaagagaacactcagaaatggggagggagaagcagtggaaatccatatgggttgaggagtaggtaagatgctgcttctgygggactgggaatgcgctgtttctcagtgacatggtctccgagaccaggagggatacacctaaggcagcctttccctcttgatgacttctacttgtccccc

SEQ ID NO: 6586 - DNA, 201 bp, Homo sapiens
ttggaagaccaggtgaggtgatggtctcttccctctccacagaccacaagttgaagtcagggactaacaccaagaaggccctccaggcagtgtacagcatkatgagctggccagatgacgtccctcctgaaggctggaaccgcacccgccatgtcatcatcctcatgactgatggtcagaagggacctctctcctgtccca

SEQ ID NO: 6587 - DNA, 201 bp, Homo sapiens
ggacatctcagaggtggtcacccctcggttcctttgtactggaggagtgagtccctatgctgaccccaatacttgcagaggtgagagaatgctctttggtygtgctacaagtgcccaaggcccaacagtccttttctctacagcttctcctctccttgcaggtgattctggcggccccttgatagttcacaagagaagtcg

SEQ ID NO: 6588 - DNA, 201 bp, Homo sapiens
ctgggggcgcttcccgaacgcaggttgtggggccttgggggattgtttccctggctcgaggttcgggatgcagagtgcgcgggggcgcagcgagggctcgmggtcctggcggggtcagagcgcgcgggctttgcagatttgggggagggagtgcggggtcgggctaaagttccccattacctcggacggcttgggggttct

SEQ ID NO: 6589 - DNA, 201 bp, Homo sapiens
actggtgtctccactcagagtcaggttggtttccagggtggggcaagggtctcccttttctaatatttggtgtggacccttcaggtgctctcctaggctgkctgttcacatatctctgatggccctactctccagccccatgccctggccaccattcacaggcaggcaagcagtcctctgccctgggagaaggccagattc

SEQ ID NO: 6590 - DNA, 201 bp, Homo sapiens
gtagctcctttgtttccattgctatataatattccattgtgtgactctaccacaatacatcctgttggtggtggtatttggtctgttttcaatttttggckattatgtatatggctactatgagcattgtatgactgtcctgatgcacgaatatgtgcacttctgtaggcacgtatttaggagtgcaattgctggttcata

SEQ ID NO: 6591 - DNA, 201 bp, Homo sapiens; identical to SEQ ID NO: 5527

SEQ ID NO: 6592 - DNA, 201 bp, Homo sapiens
cacatgcttctccccagtggaggagtgcagggttgtgcccatggtggcagacatgcagtcagtgacgatcttcaaagcctctcctttgtctctgctgtgcytcgcaagacggcttaaaccctgtctggaataatgctgatgaaatgcatttgtattccctgagcccaagcaacccagatgaaggaatgatagagtttgttc

SEQ ID NO: 6593 - DNA, 201 bp, Homo sapiens
ctccccagtggaggagtgcagggttgtgcccatggtggcagacatgcagtcagtgacgatcttcaaagcctctcctttgtctctgctgtgcctcgcaagayggcttaaaccctgtctggaataatgctgatgaaatgcatttgtattccctgagcccaagcaacccagatgaaggaatgatagagtttgttccctaatgct

SEQ ID NO: 6594 - DNA, 201 bp, Homo sapiens
ttctccactaccttgaggctgtgagtgccttcaggtcggggagcatctaggtacccccaggccctagctcaggccctgcacacagcaagtgctaattggcrtggagggaaaacatgcacagtcagcagaggcagagcaatttcagcgcagcctcagtgcagagcttgctgtagccccagtgtcacactgaccgggtattat

SEQ ID NO: 6595 - DNA, 201 bp, Homo sapiens
tgagctgtgatcattccactgcattccagcctgggtgccactgcattccagcctgggtgacagaacagctgggcatggtgcgggtgcctgtaatcccagcwgcggtgggaggatcgtttgagttcaggagctctgggctgcagtgcgctatgccagttgggtgtctacactaagtttggcattagtatggtgacttcctgg

SEQ ID NO: 6596 - DNA, 201 bp, Homo sapiens
cccagctgcggtgggaggatcgtttgagttcaggagctctgggctgcagtgcgctatgccagttgggtgtctacactaagtttggcattagtatggtgacytcctgggagctagagctcatcaggttgcctaaaggaggggtgaagcaaccaaggtcagagacgaagcaggtcaaaactcctgtgctgatcagtagtgggc

SEQ ID NO: 6597 - DNA, 201 bp, Homo sapiens
gagctcttgccagtgcccacacttcctaccattgagtggacacagttgagctggcgagtcacctgttgttggacatttaggtagttgctgaattttttttwatgttataaataactctgccgtgacaaataggaatctgacgggaggcttttgggggaagggcactcttgccagagggaatggtgtaagcaaagcaacaga

SEQ ID NO: 6598 - DNA, 201 bp, Homo sapiens; identical to SEQ ID NO: 5498

SEQ ID NO: 6599 - DNA, 201 bp, Homo sapiens
tgtgaccaaccggcgctgcaggtgcggggcgggccgggctgggggcgcttcccgaacgcaggttgtggggccttgggggattgtttccctggctcgaggtkcgggatgcagagtgcgcgggggcgcagcgagggctcgaggtcctggcggggtcagagcgcgcgggctttgcagatttgggggagggagtgcggggtcggg

SEQ ID NO: 6600 - DNA, 201 bp, Homo sapiens; identical to SEQ ID NO: 5503

SEQ ID NO: 6601 - DNA, 201 bp, Homo sapiens
ggctgagagctcaagtaagggctgctgtttttgactcctgttgaccgaggagccttactcttgatttaggcatagagctggaatctacctgggccagccascgcaaggacagaccctgctcatagccaaagatagcttccctgagctagggagagggtgtagggtgagcaatgcacaaagattctatgctgctctgtgttg

SEQ ID NO: 6602 - DNA, 201 bp, Homo sapiens
caataactcataatctgatttggaggtttgccctttacaggggcagattttctgctcagttcaacaatgaaatgaagaggaactccctctttctacagctyacttctatcagaggcccaggtgcctcagagccacattgagttgctttttctgggatgaggaagtagggttaaactccccagtttcctgagggaggctcct

SEQ ID NO: 6603 - DNA, 201 bp, Homo sapiens; identical to SEQ ID NO: 5505

SEQ ID NO: 6604 - DNA, 201 bp, Homo sapiens; identical to SEQ ID NO: 5508

SEQ ID NO: 6605 - DNA, 201 bp, Homo sapiens
tgcagaagaggccatctcccatgagtggtgagcagggtccaggggagggtgggagaggccagggtccccctcacacccagcagccccatctttgaggcctrgaaggggtgcaggtacctagagctcagggcagcccagaggctctgcctggtagtccctggatgccacatagaagggctgagcagagtctccacaaaggct

SEQ ID NO: 6606 - DNA, 201 bp, Homo sapiens
tcatatgtaggctgttgcacttcaggcagccaagctgagtagctggatgtctagccagaaaagcaggggtaggatctaagcctgcctatcctctagccccycctggtatggtctctgcccctagcttggcctgagccaggttggggtctcccaaaagcagcccctatgttgtggggaagtggagagtagtacagctaagcc

SEQ ID NO: 6607 - DNA, 201 bp, Homo sapiens
accacaatacatcctgttggtggtggtatttggtctgttttcaatttttggctattatgtatatggctactatgagcattgtatgactgtcctgatgcacraatatgtgcacttctgtaggcacgtatttaggagtgcaattgctggttcatagggtatgtttgtttgactttagtggttttaccaaactgctttacaaag

SEQ ID NO: 6608 - DNA, 18 bp, Homo sapiens
gaaggaatcgctttctgg

SEQ ID NO: 6609 - DNA, 18 bp, Homo sapiens
gaaggaatcgctttctgc

SEQ ID NO: 6610 - DNA, 24 bp, Homo sapiens
gggtgtattcacaaattctgttac

SEQ ID NO: 6611 - DNA, 22 bp, Homo sapiens
cagttcgtgctattgagaaaat

SEQ ID NO: 6612 - DNA, 22 bp, Homo sapiens
cagttcgtgctattgagaaaac

SEQ ID NO: 6613 - DNA, 24 bp, Homo sapiens
caaagaaaaacagatcacacagat

SEQ ID NO: 6614 - DNA, 17 bp, Homo sapiens
ggcttttctgccaagaa

SEQ ID NO: 6615 - DNA, 17 bp, Homo sapiens
ggcttttctgccaagag

SEQ ID NO: 6616 - DNA, 23 bp, Homo sapiens
gcagttgtgcgtagtagagtaca

SEQ ID NO: 6617 - DNA, 17 bp, Homo sapiens
caggagagccaggatgg

SEQ ID NO: 6618 - DNA, 18 bp, Homo sapiens
gcaggagagccaggatgt

SEQ ID NO: 6619 - DNA, 22 bp, Homo sapiens
ccaggtagcactgaacacctaa

SEQ ID NO: 6620 - DNA, 17 bp, Homo sapiens
ctcaccttccagacccc

SEQ ID NO: 6621 - DNA, 17 bp, Homo sapiens
ctcaccttccagaccca

SEQ ID NO: 6622 - DNA, 19 bp, Homo sapiens
aaaggacccctcaaaacag

SEQ ID NO: 6623 - DNA, 15 bp, Homo sapiens
tggggttggggttct

SEQ ID NO: 6624 - DNA, 14 bp, Homo sapiens
ggggttggggttcc

SEQ ID NO: 6625 - DNA, 19 bp, Homo sapiens
tgtccctgtcctccttcag

SEQ ID NO: 6626 - DNA, 18 bp, Homo sapiens
ccaggtgatccaggagag

SEQ ID NO: 6627 - DNA, 18 bp, Homo sapiens
ccaggtgatccaggagac

SEQ ID NO: 6628 - DNA, 18 bp, Homo sapiens
tccatggcgaaaattttg

SEQ ID NO: 6629 - DNA, 20 bp, Homo sapiens
ggaagtgacaacacaaaacc

SEQ ID NO: 6630 - DNA, 21 bp, Homo sapiens
cggaagtgacaacacaaaact

SEQ ID NO: 6631 - DNA, 17 bp, Homo sapiens
ccgcccaggattctcta

SEQ ID NO: 6632 - DNA, 17 bp, Homo sapiens
cagctgctgctgtccat

SEQ ID NO: 6633 - DNA, 17 bp, Homo sapiens
cagctgctgctgtccac

SEQ ID NO: 6634 - DNA, 22 bp, Homo sapiens
catgaacctgtcaatcttctca

SEQ ID NO: 6635 - DNA, 18 bp, Homo sapiens
ggtggtgatcccagtcac

SEQ ID NO: 6636 - DNA, 18 bp, Homo sapiens
ggtggtgatcccagtcat

SEQ ID NO: 6637 - DNA, 21 bp, Homo sapiens
tcttgttttggcaccatttac

SEQ ID NO: 6638 - DNA, 22 bp, Homo sapiens
ttctgacatttcttttctgtca

SEQ ID NO: 6639 - DNA, 23 bp, Homo sapiens
tttctgacatttcttttctgtct

SEQ ID NO: 6640 - DNA, 18 bp, Homo sapiens
tggagtgggcatcttcat

SEQ ID NO: 6641 - DNA, 13 bp, Homo sapiens
catcccgcgccat

SEQ ID NO: 6642 - DNA, 13 bp, Homo sapiens
catcccgcgccac

SEQ ID NO: 6643 - DNA, 22 bp, Homo sapiens
cctccagagaagaagaagacac

SEQ ID NO: 6644 - DNA, 18 bp, Homo sapiens
ggggttaggtttatagct

SEQ ID NO: 6645 - DNA, 17 bp, Homo sapiens
gggttaggtttatagcc

SEQ ID NO: 6646 - DNA, 17 bp, Homo sapiens
tgtcccctcagagtgac

SEQ ID NO: 6647 - DNA, 19 bp, Homo sapiens
gtatgtttgctgccatttg

SEQ ID NO: 6648 - DNA, 20 bp, Homo sapiens
tgtatgtttgctgccattta

SEQ ID NO: 6649 - DNA, 23 bp, Homo sapiens
gagcagattcctgattttgataa

SEQ ID NO: 6650 - DNA, 19 bp, Homo sapiens
agatggggaagcatgtaac

SEQ ID NO: 6651 - DNA, 19 bp, Homo sapiens
agatggggaagcatgtaat

SEQ ID NO: 6652 - DNA, 19 bp, Homo sapiens
ggccattccctcacttatg

SEQ ID NO: 6653 - DNA, 17 bp, Homo sapiens
cctccagggcttgtagg

SEQ ID NO: 6654 - DNA, 17 bp, Homo sapiens
cctccagggcttgtaga

SEQ ID NO: 6655 - DNA, 18 bp, Homo sapiens
gagtagccgcgtcttctc

SEQ ID NO: 6656 - DNA, 18 bp, Homo sapiens
acctccaaggagatgcac

SEQ ID NO: 6657 - DNA, 17 bp, Homo sapiens
cctccaaggagatgcaa

SEQ ID NO: 6658 - DNA, 18 bp, Homo sapiens
cctttcccagccttcaag

SEQ ID NO: 6659 - DNA, 19 bp, Homo sapiens
caggtctttgaggatctgg

SEQ ID NO: 6660 - DNA, 20 bp, Homo sapiens
tcaggtctttgaggatctga

SEQ ID NO: 6661 - DNA, 19 bp, Homo sapiens
gggcactgcttttctgaat

SEQ ID NO: 6662 - DNA, 21 bp, Homo sapiens
tcaagtctcattccaaccttt

SEQ ID NO: 6663 - DNA, 22 bp, Homo sapiens
atcaagtctcattccaacctta

SEQ ID NO: 6664 - DNA, 25 bp, Homo sapiens
cttgcacatcctataaactcattac

SEQ ID NO: 6665 - DNA, 16 bp, Homo sapiens
ccacttcgggttcctc

SEQ ID NO: 6666 - DNA, 16 bp, Homo sapiens
ccacttcgggttcctg

SEQ ID NO: 6667 - DNA, 17 bp, Homo sapiens
ccctggcttcaacatga

SEQ ID NO: 6668 - DNA, 18 bp, Homo sapiens
cacattcacggtcacctt

SEQ ID NO: 6669 - DNA, 18 bp, Homo sapiens
cacattcacggtcacctc

SEQ ID NO: 6670 - DNA, 16 bp, Homo sapiens
cattgcccgagctcaa

SEQ ID NO: 6671 - DNA, 18 bp, Homo sapiens
gctctgctgtaagctcgg

SEQ ID NO: 6672 - DNA, 18 bp, Homo sapiens
gctctgctgtaagctcgc

SEQ ID NO: 6673 - DNA, 20 bp, Homo sapiens
cccaagtccctctcctatca

SEQ ID NO: 6674 - DNA, 17 bp, Homo sapiens
gccttgtgaccacacca

SEQ ID NO: 6675 - DNA, 16 bp, Homo sapiens
ccttgtgaccacaccg

SEQ ID NO: 6676 - DNA, 21 bp, Homo sapiens
cctccctagcatctctgactt
